United States Patent 7,504,493 (CHARACTERIZATION OF THE YEAST TRANSCRIPTOME) - sequence listing, part 2

SEQ ID NO: 12207 - DNA, 1531974 bp, Saccharomyces cerevisiae
acaccacacccacaccacacccacacacaccacacccacacaccacacccacacccacacacccacacccacacaccacacaccacaccacaccacacccacacccacaccacacccacacccacacaccacacccacacccacacaccacacactacccctaacactaccctattctaaccctgattttacctgtctccaaacctaccctcacattaccctacctccccactcgttaccctgccccactcaaccatccactcccaaccaccatccatctctctacttaccactaaccaccgtccaccataaccgttaccctccaattacccatatccaactccactaccacttaccctactattaccctaccatccaccatgtcctactcactgtactgttgttctaccctccatattgaaacgttaacaaatgatcgtaaataatacatacatacttaccctaccactctataccaccactaccaccaccgccacttgccacactcaccttcacttctactgatatgtcatacgcacacggatgctacagtatataccatctcaaacttaccctactttcatattccacaccatggccccattctcactaaatcagtaccaaatgcactcacatcattattcacggcacttgcctcagcggtctataccctgtgccatttacgcataactcccacgattatccacattttattacctatatctcattcggcggccccaaatattgtataactgctcttaatacatacgttataccacttttacaccgtatactaaccactcaatttatatacacttatgccaatattacaaaaaaatcaccactaaaatcacctaaacataaaaatattctattcttcaaccataatacataaacacacttaattgcgtcttaatactatcatggtatcattaacttaaagttccttaatatcgtcataccactatgctctattccatatattgtaatataactgtactctatagtcatacagacgcttttacttcaccccatcttctcatactattgtcatagaatctcacactgacgcatgattaaaacgaataatttttactgtaagggctgccatccgcgctctatccttttgtttgcaatatttatatacagaatctcaaaacaagcgggagaagtgctaattacccagaggtcatgcatgatctgagtaccaccgtacctctaggttttgctttgatccgttttacagtgacaccgaacataaggggaagctattgacatggtatcgaaaggttgtccacattgggaagtaacttggttctatgaatcttcatgtcagatacgtaggacagactctttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccttaaatgtaaaccaacgttacggcacaccgtgatgtacccgcattaaagttttgtaaattcgttattacgattattgaattggctagatagaaaacaggaaatgaaatggatacccttttcgaatagctgagtttctttgcctaaaatagcccaacattgttgccctttttctatcacgaggttactgagccattgcatgaacgcgcgcgcctcggcggcttttttttcctgctgtataaaagcgaaaagccagaagttactatctcgaataaaaaacccctcgaactgccatctcactaccgaaaatgaaagagaatgaagtcaaagatgagaaaagcgtagatgtgttatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagagattactgaaaacacaccaagttctgatcctcatgattgggaagtcgttgtagcaaatctaaattcgtacttatatgaaaataaggcttggaatactaagaatttctttttcaatgctacggattgtgagaaaatgttcagaacaactgttcttgaaccattttctttgaaaaaagataaagctgccaaggttaagtcatttaaggattctgtcccttatatcgaagaggctttgcaagtgtatgctacaggatttgacaaacagtggaagttgtttattactgaaaaatcatggagccctgttggcctggaagacgttcagcttcccaaggatattcatcggtccaagcttacttggtttttaaagcggattttcactatttactctctaccattatggcttgcttttttgaactgtatctgcgtgtcacagcatttttgccttgcatttcgtatcttgtgtcctggattgtttttcctcatgatggtgtggcttttccaaaatatgaggacgactgctttactcgtgaaaatggaacacaagatgcaattcttgttgactattataaatgagcaagaaagtggtgcgaatggatgggacgaaattgcaaggaaaatgaataggtacttgtttgagaaaaaagcctggaagaatgaagagtttttcttcgacgggattgactgtgaatggttttttagccacttcttctaccgccttctatctgcaaagaaatctatgtggcttttaccattgaatgtggaactatggccatatattaaagaagcgcaattgtcccgcaatgaagagtctttaatgaagaaatgagaacgcccttctggacttaaaaattcatacttttgcattctgttagatatgaatactacactctattgagtgactttaaaaggcgagtggacacttttatcaagcgatttatcatgcagtaatactaatattactaattaatcactactacctctcttaaacaggaaatatgctattcatcagtaagaagctgcacaaatgttatatatcataccaggaatacacataagagcaaaaatgctattctacaatatcctcatcttaccagctcactcacaaaatattcttactccgagtacgaccataaagcaatgctaacgaatagtcatactaaagtactataaaatctttccgtgcgctcaaacggaggccatgccataaagttaaatgtgataacttaaaagcatcataagagtgattttccagtattgtttcagtaatgtaaggcctaaagaagaacgcatattggtaaacctccaacctactagtaattaaaaagctttagtttaacccgtagttcgggatacacttcgggcataacgtacgtttattataaatttttatatctcttgcgtaccatgtatattccagaacagtgaatacacttttctagttcatttatgctactttcatatcctccattaaagcgggagctaccgttgaaaaggcataataattgaagtttcgagtgggttagttacactaggtgaaggatcgtttgcctccatatggtcaagccattcacggacattgataatagctgggacaattctggtttcataaaaggtttcattcatccagattacagatgcattcaaataatagtcgccaaatactgatacctcatcaaaatgaaaatatgtttctaacggaactgtattagaccatgcgctcagttagctggagtcgcgttggttaacaaattagctaaattcaccattactttacttaaagacctatcaccacaaaggaaatggcgattctacaacaggaccagcttcactgtttttaccgttgatttaaagatcaccttttgactattttatatgccaattcagaaaccgttataatagaagttttctactacaaaatttacaggatgttgtagcttgattgcataatatttttttaaaacggataaccaccaaccctcgtcagtgacttcccattatgaaatttttctcttcttatcctttttggtaccctttttcctatcatgcgcctcgaaacaacttccatagtacgtgcctgctactgtgagtagtttactgccgcagtgaaacactatactgattcagcatccatcagtaagtgcgcgctaaaacgacaactttttcgtacctttacaagtaaggagtggttaaggtgtatagctcatactagatattaaacttcggagaaaagtccctgtttcaatgacaaatatgagttgcacaatagaatttttatatctatgattacgcttggtaggatgaaactcttaaattccgttataagttttataaatcgccgtaattgcaaaaatacagggtgatgcgtataagtctcataaaaatcaaatcattccctctattgcaaccatatcaaattttgatgatgattattttacaattttcattgccatggatgaaaataaacgctgatatctttataattaacccggaatggaaattgtgcacagtacatcaatggcgtttcgagtattaagacctgtgatttagagccaattagccaagtaaagcgacatttcctttctatgtttggcatcttttttttttggccttaaaacagtgtttctgtaaaattaagggccaactcttacaatagtaatgagattaataaggcccaaagaatattttggccatttctttttcgtacaaccatatagttttctcaagtagcgacgaaagagagataactgaaacaaaatgtcatggaagaagtgcttatattaaaaaatctatgtcggaaatatttctatagggaaaagtatactaaaatcttactcgagctttgaaatgaacaagcctaaaccgcccaattccaagatctttaatatactataacttgaaagtcatacctgttatatcactccagaggttattgtgggagcatatttaatgctttgtgggtaagcttgataaactgtagttctaccacttttcccaggatactgattatggtaaaagttcttatttgtcttacgacttagatttagcactcacatttgtcatcatatgttgaaaaatcaagctggaatttattggtggatctttcatctccatttatactttttacttgtttttctccaagcaaaaagatttcacgttgttcgggaggtaaatatgaagtagaagagcagtcaggtagagtggttatcccatcagccagaacctgtccgtaaacaggttgtggactacagtatgtgtgtttttttctttctagttactcaatatggatattttggtgactataaagacctctcgtaaatttctgaaaatatgcttcggttcgaatctgtggtctgcagtgcagcgtgttggtattttaccgacagttttagcgaaatatgtatagatctgtcacgcttgcaacatcgcgacaggtcggtatactaaaattacagcatgaatttctgatctataatcacactgttgcagtttccagagagtcaatcatattaagtcctctgtttgaatcaatgttggctttgttcttctggagaggaatcagctcgttatatgtttgtctttttctctgctcgagagtcatcgcgacattccacaccccgcgttttacgtgcacagaatctttcgtagaagggagcatttgacatcctgtcagccatatgcaatgagtatgccacaagttcatgatagtgttgactatagaatataaaaaaaaggtggggtcatctgtaatcgttgtttgtaattcttagaggcctgttcttggaattattatgcaaagattaccatcacaaaatctaacacaaatagagatacaggtcttgtaaagccattacctagctatgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaacccccctaaagacgtctctcataacgaccccaagggagatatcgaagcttccattgcagaggaatagcaatgtatcccatcacctatgagctaatgaacatttatcgacacaggtaaataggtaactatggtatttactctacatgttacggagtataatacacgtagatttgtttcttcctcatattcccatgacatgtctcagtaattgaactcaaagtaacatttagctttcttcttgatcattgcgtttggaaatgtatagttagagaaaagattctttctcatccgagtatggcgcgtgaagaaaatgaagatggagttgtcgaaacaaatggtcatcgacattagtttaattgtcatagtaacagtctgggcactcacttcgtacatcccttatacatttaagtgcaattttacctattctaaaaatagaaaaaatctcgaatgagcagttctggcagtactgaaactgagttaaaaatctatcaactggaagtaatgcggtagttttatatatgagcaatatatgccgtcaaattatatgtacagtagctaccagagcggttattatattgttcttaatcaataataaacaaatcagagtatatttcataatttcctcttacatttttaagaaaaaagggtaacatttattcctcattgatcctatctttcaatcctaataagcgacaatattcttagcatatacgggagagttgctctcactcatatcatatagctctctatatgtgtcagcgctctgatttgtaaaataacatattcttaagctttttccgcccattttacaatattagatatgaaaaagttagtttttaagtcattaaacgtgtctactatttaaatttttatttttcggtgttattttcaagtattactgcttttgaattggtctatatatatggacatgaaccagtgccgaaaagtattcacttttcattcaggaccaaagataatagtcttgactacctctccaccatgggcaatgttgtagtcgtaagccttggctgcatcttcaaatttaaatttgtgggttatcaatggcttgacattgacttttcctgtggcaaccaagttcacagcgtcacgataatcaccgaatgaataacggaaacatccaatcaatttcatttcctttccactaacttcagcaattggaaaattagtgtagtttttacccataccgacttgcaccatggtacctccaaccttagttgttttgacagcggcatcaatgcaaacatcagcacctgaacactcaaacaccacatctgcgtgatttccgcccaaaagcttttggaccccatcggccaagtcttgggctttatcggtggaaaactgggaagaattgaaagtgtttgtggctccgaaatcttttgctctctgtagcttgttgtcgaatacatcgacgaaaatgacgtcggtggcaccaaaagcgcgggcgactgcgccagttaaaagccccacaggacctgcaccaaatacaacaactttggtaccaaagcggaccccagccaatttattagagtgtacaccgactgataagggttcgacacaagcgccctcttcataactgacgccttctggcaatttcacaaggaaatcttctggagataaatagtacttcacaagagtaccatcaattggaggagttgcagcaaatgccatatgtgggcaaaggttatagctcccttctttggtctcatcagagtaacggctaggaacaccaggttcaatagcaacacggtcaccaactttgacccttgtgacggcatcaccaacttccacaacctgtccgcttgattcatgacctaaaaccattggcgccttcaatatgtacttaccaataccaccgcttctataataatgaatatcagagccgcagataccagtggctttaatagctaacttgacataatgggggtccttaatggtagggattggtctttgctcgatggcaatatcgccgactttctctagaactactgcagggttactattttgagacatatttttcaatttttttttttagtattttttcttgttgattgtttgatgtttcttttttccacttatactatatctcttcataaagatgaacggtaagacattgagccttttatatgtcgaatttttttctatatattaaagagagagtaagcaacttatggcaatgaacatactttagatggaagaaatgcggttagcaaggtgatacagaggcttcatgtgaccggagaaaggagatacgagaccggagataatagaatatgatgaaccttaactgttgaagaggaagaaagcattaaagtgcttggtaaagacaacagttttctgaacgaagttccttcattattcaccccaaccaagcccgatggttcctgaagctaggcgtaactttccaacttcaacatagattttgccactcggcagtagctgtccgcgaaaactttattttctgcacctatatgtgcctaaaacttactctcctgcagggagctcgagaaaataagggattgtggggtaatctttagtgggggtatctcctgtgccttcccccgtaatttgtttgccttcatgcctgcctctccttgtctcaggtcacaccattcacgattccttcatgcctgctaccgatttagtagtaagaaaagccgtggcaaacagtcaggtttacaccagcttttttccttggaattgttagcccgccttttggtcgtaatgcacaccacaataatacgtcattagtcaaagttttcacaaaaaattgataaactaagctttcgtactaattgtagagatgttgattcgacagatgaacggttctatagtttcagtggacgtagcgctttgatattaaaaaattatgtacaatatcatgttaattagttgaaaaatcataatgtcaattatcgcaaaatgaaaagaagaattggtactcatccagagtttcaatttagcaaataaagtaatagacaattcatcaagctttgaactttgtcgtaagacctttcaaaaaggaaataagtaaaaagataaagaaactcaatagacttggaaaaaggatagaaatggacatatgccgacttaaatgctaaaaccctcgactgttttgaacccattgtttcaataccgtgtctttaacggttactaccacagttaggtcacaaatcttttagtggcagatgctccttgaactactaatgacccaggtcacccagagaggtcagagactttgtacgggtacctatatgaggtctttttactgtattacaaaaaaaatcttactccattcgctattatgttgtgtggaaacatgcctcaaaatgttttcaccgcaaaaagtatgcttgttgtatttgccaagttaacgaagcatgagaaagtttgcccccccgagttgaaacaaagttatctcttctaatatgatggttgtttgtgcggccacgctaataacgagctcaaatattccctttatagtaacaactgaatatttgggaagaatctatatttctatattattgtatacactttatttagaggaatggtacagtgttacgttcctggaaatgcatttttaaggatcttccataagcactcaagtggacctatgttgacttccccatcttcatcaccactccgttttcactccataagcatcctactttttatactctgctttgccttaaagaaacagaacttcgtacaatgttgccttaaccaaacgctttctttcactaaataactcgttattttatatagtactagtagtccgaaaaagggagtttgcaaagaaactcgtagttttttgttgattaaatttgaaattacgtgtcacttcgttttacagtaggccctattttttttcaagaatttatctcttagcatgtttatcaagcgcgcatattgatcaattaaaactctttgggaacttcaaaacttctttccagcttttcttcttagcctcagtttccctggaagaagctcctctccttgagggtggtacccaagatgcagatttccatggttttataccttcttcatatagtaactggatttcctccaaagatagaccaattgtttctggtaaaaagaagaaaacgtacaaaaacatagcaaccaaacaacctacgaacacataaccataatagaagtggatagacccagtaatgaatggtgtgaaaaaaccaatcaagaattgccataaccagttgaatgcagtcgaaattgacattgctttagatttgaccttcgaagggaatgactcggcaaccacaatataagcaacaggggcccatgtcgttgcaaagcagaatatatagaagcatgtgaacacaatcatggcattacctgcacctttcgaggatggaccatcctggccatgagggtaaagacattttaccccgatacttgcaaatatgaccatacaagccatcattgaagccgctccgaataacagacatttacgacggcctattttgtctacgaccataacagcaataatagtggagaagaaattcactgtacctaggacgatcgaagtctcaaacccatcagtaagcccaactgatttgaaaatggtagttccgtagaagaagaagtagttttcaccagtaagttgcaaaaaggtttgcacaagaatacctgtgatcaaacgttgaaggacttttgttttgacggagaaaagttctttccatgaggcttcccctagttctctttgggcaaggacaccggcgttgatttcatcagcctgtttgagtacccatggatcctctggtgaaaccttgttgatcttggcgatggagacacaggcctcttcatgtctctcacattcaatcagatatcttggggactctggaactaataacatgccaacgatgataattagagcccacagaaagcatagtcccacaggaatcctccattgcgcagtattactatacttccttgttccataaacgctacaataacccaagaaaataccgaaggtcatgttaagttggtacaatgagacaagtccacctctcaaatctgtgggggctatttcagataaaagcattggacacaacaccgaacagccaccagcaccaagaccgtagatgatcttaccgacaaagtattggtaccatttgtgattcgaactgatctgaataattgcaccaaccatatataccaaaaccacgattacaattgctagccttctacctaaagtatcagcaagtctcgcaaaagcaacaccgccaatggaacatcctacactgaacatggccacgagaagacccatacgcacgttgctcaaataatactcaccagtactgtgcttgtaagaaccaaaattcattttaaagttatccatattgatgaagcctgcagtaataccactatcccaaccaggtaaaaaaccgccaaaggatacaggatagcatagtaagtagataataaggtaacctaaaaagcctctcttcggtgcgtctggcgtatttccattaatgacttctttgtcataaaacccgtctgaccattctttctctccgggtggctgtacatgaacgtcagctgcactactgtttagattatctgcattaatttctggtgaggactgttcgcttgccatttttttcctttagtttcctttcctccttttctgtcaataatatcaatagttttacttctatggatagtaataagactaaacctgaagcaaacaatgaattacttactttctttatacgtttgaaagttggtgattacaggccaacactggagttatcatacttgagttatataaccatgtttaacttttttgcagagcattcggaaaatcaaacctttagctgattgcacttatgatattgaaaggttcaagatgcgcagtacaagtcctcgtttgtttacatcatctaccttgcctgacttctttgctaaattgtgcctctgcgcagtgcacgttcaaaagaaaagcataccccgcactctactgtttttgcattttagcttttaagttttaagttactaccactgtagcgcacaaagctaaaaataattttgcctgcagcaggctagctgcatattcataggcacatcatgaatttactgtaatacgagacggagttaagcaaaacggagttaacacaggcggagacatgaaacaagttcaacttcagtaatagtaattgtcacgcaatatcttgtggaaatttgcgtacaagattttttaagcgccaaaggagccaaatacggaaataattacctagtccttaccaaagaaataaagaaaaagaaaaagaaaaactgcaaacgtataagatatttggtacattttaagaaggggatattcactttaatgatcatatcgctgatttagtaacccagatcaaggacaaagttactattgtcgtcttttaaggtggaatctgtggttaggatctttacgagtacctagatgatgtcatctttatgcctaagaggtctagtgtcataatttgttcaacgttgcttttacctctggcaatactccacaatatttcaggatttgctgccaaagtccattttgtgcaagagaatgtttattactgttttgatcgattatgttatcgaggattctgaaaaaatggtttatgtcatccgtctgagaaattatgacggaagaatgtaagctgccggttacaggtaagcaaaatatttgcaaaggaattttgagaatttatggctcgacggcgagatttgaactgtaaacggatatggtgaaatgaagtaagggcataatattatccagcagctgttctcccatatagtgcgccaaaattgtaaacattttttatatattacgctttctccatgtgcaggtcaattttattcttcttttcgttgaagtgatgttacctcatacaatgattcaactatagcaccgtttcatgctaagttatttgcacattctccttaccacaattccgtacaatttaaaaatttgaataaagcagtattgcaacaaggcgttacagtctttgttaccctaagcatgtctcaagaatctattcatgtgtgttcatggctcttcttaagataatatttcatacctggggtggccgtttcatatttctgtttctctaactttataccaggagaattccttgtctaatttgctacaagtaccttttcaatataaataattttcagttaattaacagagtaggaagaggaaggaacaaaaactatcgcttatcttcttgcataggggtagtggagtaaagatacaagtattcgagaaatagatatacattaaaatagcattactatcccgggaatcttgttgccataaggtgcttttatgatatcaaaccaggggggagaatatttgggaagtaattgggaagtaattgtatgtatttctaaaatttttggatactcaacttttaaattcaaaatagttatatttgttatcgaaatgtagtagaaatattctaagtaaccaatttcaaaactgcatctatctttggataaactggtgtgataagatatacattgaatgctgatgtccatcacacatatgtttacactggcgtcgctctgtacctatttcagaatagattaatgacaaagtaaaagttcaataggcgggcggaaaaaattagagattcattgaatctctaatttatttaaagtttataagtcgttacatatttttctatggtaagttcctggatgttctggtacatcgagcgtatttaatatgtccatttggcatgtcctttatatgcccatcttgtataaggtagttttaaattctaagttattcaatactactgactaatcattgttaatagcaatttcgcagtcatgttgggctcaaaatactatagtcatttttgtgattttttttttttattattttgattgaagaaggaacaattcgaaatatggagaaaacgtaaaaaatgttagagttataatcgaaattatcctagttcagatactgaaacttaggcataggtgtagtcacaaggtatttccctttacatatatatttgtatatgtgcattctctttcgggccaactgggatatgcgattaagcgttttgccggcgtaatgttttaagggaataagattggcgcgttaatgcataaagacagcaatcacctggaggtaacagcgttaatgcatttatcgatttttggctatgatgcaatgagctcaattcgaattggatggcttatgaactatgaaatatacgaattattcaactagcagaaggcttgaaatattacttatccaggttatgtaaaatggtgctgttatagcaaaataagcaacatcaatctcttgtgacgacagcaaacaaaacatataaaaacctcgtattatcatcttcatgaacaatattcttgtccattctttcgttcttttaccttttcaattatataaaaataccacaacaacaatacacatacttccaagctatgtctacagacaagatcacatttttgttgaactggcaaccaaccccataccatattccaattttcttggctcaaaccaaaggttacttcaaggagcaaggtctagacattgccatcctagaaccaaccaatccttcggatgtcactgagttaattggatctggtaaggtcgacatgggtttgaaagccatgatccacaccttggctgccaaggcccgtggtttcccagtgacctctgttgcctctttgttggacgaaccattcaccggtgtcttgtacttaaagggcagtggtatcactgaagacttccagtccctaaagggcaagaagatcggttacgttggtgaatttggtaagatccaaatcgatgaattgaccaagcactacggtatgaagccagaagactacaccgctgtcagatgtggtatgaatgtcgccaagtacatcattgaaggtaagatcgatgccggtatcggtatcgaatgtatgcaacaagttgaattggaagaatacttggctaagcaaggtagaccagcttctgatgctaaaatgttgagaattgacaagttggcttgcttgggttgctgttgtttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcaattgaacaacgatctatcctacaagcaatatcaaagatgttacgcttacttctcttcatctttgtacaatgttcaccgtgactggaagaaggttaccggttacggtaagagattagccattctgccaccagactatgtctcgaactacactaatgaatacctgtcctggccagaaccagaagaggtttctgatcctttggaagcccaaagattgatggctattcatcaagaaaaatgcagacaggaaggtactttcaagagattggctcttccagcttaaacgcacttcgtcactcctcgagcgtagccttcctctacgacttgtttatgatttcccattaggttttttttcctccctgatatttagatatttactattaagatattatttatgagccttttattacagcttcttttcccttgtaattatcgtacttgcctccaagtatcgaaagtcttgtgttgcctcgatttaccacttcaaatgctgtaacctgcacaatttacgcctgaattaggtgagggataaagactgtttttaggtgcggcttattcaaaagtataaaagtagatagcgtggaatatataaggacatatttcttacacaaacgcaccaaaaaagaaatctgattaatcgaaggaaatctgcgcagacattgccgtgagaagtgaagccttcttggtaacagccggatcatcaccgataaaattagtaggaaaaccaacatcaaaaggaataatactttctaagtattctatctgttctggtgtcagtttgatacttaaagcctcaatgttctgtttgaggtgttcaattttccttccaccaaccaatgggaaaacatttttcgccttagagcgaacataggcaatagcaatagcagtaacagactcagtgccatgttcctcagcaaccttggccaatgcttcactgatcttaacctctttatccgtctgtttagaagtacccgaaacagtacgcagaccctctccattcttcttccgttcctccattgcttttttactctgaaatcttccacctcccataacatcccatggggctagagccataccaaaatgtctggccattggaatgatatcgcgctcaaagtccctgttcaacacattccatttaccttgatagatactaaaaggagttttcccatgagatgtggcgtagtagtttgccgcagaaacaacccaagcaggtgtatcagacacacccaaatagaggactttgccctgctgaactaaaatatgcaaactatccataacttcttcgattgaactcatataatcccaccagtgaacgtaaagtatatcaatccaatcagtttgcaatttgcggagagaatccctcacactcacatgtaaactatgcttgtgattaccacaatagttggcacttttaccgccacctacttcatacttcttataatctccggtaaacttggtggcaattacaatttggtcacgcaactttcttgatttcatccattcacctatccaaatctctgactcttcattttggtaactgtttgcagtatcaatgcaattacctcctgcttcataaaaagcatcaagaagttcaaaagcctgttccttattcatagagcccataaagcctgaccatgcatcgccgattgaagctcctcccagaattagcggtgaaactcttatgccggcagttttagaaagaaccctgagacgtcccaactcggtaggtggttcaggtagaggtttaaataattcactaatattattgaataatattttgtagctataggaagtgtattctagtgaaatacaaagccgctcagtcaattcgtcagctggccgatgaaaggaagaactgcaactgtccttgatctggaaatattgtcatgacttttatatggttcaaaaatctgcccccaatttgttcgaggatatttagtgcaacttagttgggtcttggaacgaggtctgcttactaattttatgttgacggttgaaagcggattttaaaacgtatgaatttagaagagagccaatcaaataggggtacgcttaatattaaaaaaatattagtaattgtttgtatgacgaataaaatttgtaagcacctgatccaatccttattattgagcaagagacgtcttgtttctgtactctttgataactatcaaggcgacatgaaactaaggtcatctccatctgccattcctctagttccgtcaacgaaaattcttcaagctatggaggcccggaacgacattgttgacagtctgatcatcaatagtcacgcaacggaaagtgatcgccggactttaggagaccatgaggttagacaatgtgaggataccaacttcggcttcaaaatttgatacaggttaattttgaaggcaacatttaggttcggccttatttaaaaaaaccttcaggtacgcgttcaagatcccattttaaaggtataggcagattgcactattttaccggcaaatgtgcgaatatcgaaactggaagatgttttcaagaaaattgatttaagatccatttgtcgtgtttagagttctcattgttctggtcaatgatttcaaactcaaaaggcacaagaaacttacaaaatttgtttcttatgaacattacgccatgttctttgcgagcatgtgctatacagtcttgctagaaaatggccctataattagaaagctcaaaaaataacccaatgctgcatcgatttttggagaaagggggtcaatcatcatctatcttcataaataacgagttgcagaaaaattggaaactggttgattttgaaaagttttcatttttctggcaacaaattatagctacaaaaaaagaagttatggcgcataagatgcatcaatatatggtgtgaccagattggacgtaactagtactcatgttattattcatatccttcatttttccttcttttcttctccttctcgaacagtaacttcagattgaaagacgtgaggatgctttagaatgcacattaaaattaatatactactggcctcttgtgtttgtcattggcttctattttcaataaaacatccagacaaccctgctgttaattttggaaaaaaaatttcgccgattctaatcatgtgactccttttccccaggcaataccggagaaagcgttctatctcaaactatataatttgcgctgctcgtctccaagcccatgctagtgtttactttcggttgtaaaaggtaactagaagttttaacgcaagcattgtattatattttcccacaattgctcttaaggacctttttttttcttgcgtgatcctgcactattgaaaagtctttatcaaaaatagatgaaactttttcagggttcaacatttagaggcttttctcatattctttactcagttgcctgcgaagacccttctgcccgctgcgcattttcttagaaaatcaaaaaaattgccttttcatcttttaccttccgagttgaatatgttgactatttgcaaacaggcgtatgattgtcgtatataacagggcactttcggcagtgaatcaataggaggcgtataagaaaagccaattagtacctatatatatatatatatatatatatatatatatatattcctttattataattcctatcagcgatttttgcatcacacccaagaaaaatctataatagagacacaaaaaaatgaacgtaactgaaaatgctctattgtttaagtgcggtagcaagggctatattaatcaaacctatacgccgacagaaatttataattgtggggtagctgaaggaaagaaaactgctaaagaaaagaacccaacttattcaattttttatgatacatttctcactgggcagcctgctgaaagtcctgaaacgtttacgtgtggttcgcatggcttcacaaatgcgagttatgtggcaagcgacttttatgcatgtggttttctgcaagggaaaggtacagaaaccaatgcgggaatacataatacaaggccttctcattctctcgccaaatttaccatactgttcatgctagtgttgtatacaattgtctaattctcaaggtatgacactttggattggtggtcgcagtagccaccatataattttttatcgtttctacatataatacgagacagtcagacagaactttgggtcgcctgagaagaaagactataaaaatgtaacccgtcagtaggactcatcttaaaacagtgggtaatttactaaggaggctggaaaaactgcgataatcggcttatagtacatatatatagaataatcattaatcgagcctttaccgcgaaattcatggatttctcaaaaacaaaggtgcaattacatgttaagcaccgaatttctatgcgaaacaggtccgtctcatcagtcatagctttccaagtatataaaacttgaacgcaaaagtgcgtcatcgacgcctttttttgcgcaaggattgttactattcatttaatgaactctgatgtcttaataagccaatggtatccataagtgaaggtgaagtctactgtgttacattagcaagtcagaactcctatacgatacagtatactgcattatgggcactaaaataatttagattatagaaaatatcgatactatgcttccacttctcacgaagcggccatgttttaaatgaagtacgttaacgctaacacaaggcttgacaactttcatgagcgtcaaatagtctacgtgtgggctcactttttcagatttcttcttggcttttgtgagatgtataattaacaataatcataaaatcgctacataaaacaaagcataaaaaattacagatttcctgttcaaaaatcaaatcggtccagttcagctattgttctgccgttgttcatgctcagaaaattggaccatggtgtcatctaactttagttggtcccattaagctctcttctgtatatcatgtttgccatattgtcatatcatctgcttagtattaaaccgttgtggaaaacaagaaaattgcgaattactagtatagaaaatgcattctaagtcgcctgtgattccaatagcaaagaaattgatcttaatggaagtaggaaatagctgtggcaaagagacaggatactaagattggtttaaggcgaggtcatacttagctatttccttcaccaacattggttttcgaacagtcaagagatgaaaacgcaaaaaagtgcactataaagtaaatactcaaacgttcccaaaacaaaacgagaagaagcgataggcacctcaaaactgaaattatgggcaaacaatataacccgtaaaagatcactttacgaccagaacataatcaacatgggtggcccccatgttgtactcagttagctttttgagctagcaaatatatcaagaagcccgcatgtgctacttacgtttgaattacttctcgttgtaacgcacttttctacaacgtacctcactagtaaatataacttaatgcttgcaggttagcccatcgctacaacacctccccacaaagtatttacttcaagaaatcgatcttggcgagtatatccttatctttatgtaagtatctttttcgtcttcaaagtatgccgggtattgatgggcacggaagatgtaaacaaaatggaaaacaaataagaacagaatctgaaacgtcatttgagaatttaaaatatgtaaatcattcctctcgagccaaccaaggctgttcttgctagaaaccagcaattgggcttctcattcaaaacagtatccgtctttgccttaacattgttatttggcctttatcccagatatacgcaaccgtatttattcaaatccaaagaaaaaaagagcagacaaattatcaaacaacaagtaccggaggtgagcaatgattcaaaattctgctggttatcgatcgctgaatactgcatctccgatgaccgtgcaggtgaagaatcagaagaaaatatgcgcccgttgtaacaagttagttatacccgatagccaacgaactaaaacaactttaaaggctctcggtaaatattatcatgaaagttgttttacctgccaagactgtcagaaacctttaaaaccgaagtacttcccatatcaagtagacaagacaagtgaatctatattgttatgccaatacgattattttagaagacataatttgttatgtcatgtatgtgataccccattgcgtggattatattataccgcattcggttacagatacgacgaagagcatttttcttgtacaatatgtgctactccttgtggggttaaaaaatgcttcatgtacggaaaccaattgtattgcaagtaccactttctcaagtatttttcgaaacgttgcaaagggtgcgagttcccaatatcggatcaatatatcgagtttcctaaaggtgaagaaatacattgttggcatccggaatgttatggaattcataaatattggcatgtaaatttagcagcagaaactgttggtttgcagtaccttcccaagctggaatataacccaaattccggagacaaagatataaacccaactgcctacgagttagataaacaaatgcaggcgtttaactttattctatctaaaacgtggtcggttttatatcgttttgaggaagaggcagcttcttgcatttctgatatgtttcaatatttgacaagcaatgatcagttaaagggcatagagtctacgggtctgttggtactaaaaatcgactgtcttttccggggactggatactttaaacctctcgacgaacaaaagtatgccagttaacagtgatcaagaatgcattgaaaacaacgcaatggcggccagtaaatacagcaagtttcccaaaaatctgtccacaaaaattatgatatatttacaactcttaagaaagttagggacagaaaacaaaaacgaaactatcacaatttcatcttttatgtctgttattactggattagcccattttctaaaactgttaacaagatttgggctatatacggctctagaaaacaataagttgactcattctgttaatccattgttgaggtttttaagagaagtagagaaaaatgagctttttgaaaataacccgtttcagtatataaagactcctgttaacgccacagatagttgcgctggatgcaataaatacatacaggaggaatgcattcaattttatgagcaccggtggcatattgcttgttttacttgttcttcatgccataagaatataaatccgaggagtttgacggatcccacctttaataaagagaaaaaaaagatactatgttctcactgctcaattgatgatccggcctctgtgccgggtttcaaatttgttactaagctagcacaactaatttttcttctaaaaattgccctagtcaaatcaagaactgtaatgttgaaatcgaaagcatctaacaaggtaggcagaaactctttacagagtactatgctaaaggaacacacttacattaggacactgaatgatattaaaagattgagatctagaagagaaagtgttcgggtcactcataacaaacaacaagctagaaaatcagtgatactggaaactgcagagacagatttaaatgacccgacaaaacaaggagatagtaaaaatcttgtgattcaaacagatgacccatcatcgagccaacaagtgagcacacgtgaaaatgttttcagtaatactaagacgttgacactagatgatatttcacgtattgttgccgctgaacaagcaagggagctaagacctaacgcttttgcacactttaaaaaactaaaagaaaccgatgacgaaacttcgaatgttgttcccaagaaaagcggagtttattactctgaattaagtacgatggaactctcgatgataagggctatcagtttgtcactgctagctggtaaacaactgatatcgaagactgatcctaactatactagcttagtctcaatggtcttctcgaatgaaaagcaagtcacaggtagcttttggaacagaatgaaaatcatgatgagcatggagcctaaaaagcccatcactaagactgtttttggtgctcctttagatgtgttgtgcgagaaatggggtgttgattccgatttaggtgtggggccagtgaagattaggatccccataattattgacgagctaatatcatctttgaggcaaatggatatgtcagtagaaggtattttcaggaaaaatggaaatatcagaagactgagagaactaactgctaacatcgacagtaatccaacagaagctccagacttctcgaaagaaaatgcaatccaattatctgctcttttgaagaaatttatcagagagcttccccaaccgattttatcgacagacttatatgaactatggattaaggccgcgaaaattgatttagaggatgagaaacagcgtgttatattgctaatatattccttattacccacttacaatcgcaatttactggaggcacttttgtcatttttgcattggacgtcctcattctcttacattgagaatgaaatgggatcaaaaatggacattcacaatttatccacagtcataacacctaatattttatatttgcgacataaagaaatttccaatgataacgtccctgacgaaccagaatcaggtttagttgattcattcgctcaaaacaagggagaaaattactttttggctattgagatagttgattacctgattactcacaatgaagaaatggcaatggttccgaaatttttaatgaatcttttaaaagatgtgcagttacaaaaattagataactacgaatcaatcaaccattttatttccaccgttatgcaaagtaaaacaatcgattattccgaatgtgacataaaaactcctgtcacagtcaaagattcgaccacaacggtcatacaaggtgaaataaacaaataataggcagaaactgtaagtttcccctcattttcctttttttcttctccttcccctcagatttcgaggtttgtcgttcttattagagttctttgcttttttctttgcctatttcaataaaatcttaccagtatgctatggaaatggacattattttattattatacaacatagtatattctgactaaaatggaattagaaattgtaacattagtatgtacttataatcatttgtatcattgtattactcgccttttgatgtaaattttgtttatatctcagaacatctccaacagcagatcagaagttacattgttcttgtaagtgcttaagaagtctgttagcaaattgaaatctttcagaagaatattccaccaaaatttcggaaaagcaataccagcggtaaaatatctgccatgctctatattatgtgactttattttaggtgcaccccccaccagtaacttattctctaaataataattaatgacaccattgaatatattagttctaaataaaaaaaaaaaagctaagaaaagaaatatttaaacaacgcttgcaaatcatactcaagaggatgctttacttcagcaatatcatgattgttcaaaaactcattcattgcgacctttcttctacttttgaaatctaactgtttaccaaaaaccttaaggttcaaatcattagcaaattttgtgagaagtgtaagctcacatctaagttgaatgacaattgttggtacaatttttaagaaggtttttaatgggatatccaacacaattaataaatttttgattagattttgcgattgcacataggtaaggtctgtcagaatatcaagacccaaggagtcgtacttttccttcgttatatgtggaaaagattttccaacagtttcaaaattaagttcggtagaaggatcaccatatagtttttttaaattcagcttctcttggaatacatcttcttttagtgatagaattgtttcttcgagttttaatatttcactttgttttccagctaactcgtcagtaattttcttatgtgtgttttctgactcttgaatttgagtgctccatcttgaagcaatcaaagcctgattctgaagtttctcaacaatttcctggtgttcattcatgtaatcgttcaatttatcttcggcatttttctgaattttttcacttagtattaattttccttttaactcgctcttcagtttttgaaagttttcttccttgaggttcaggatatcatgccatctccttttttccaaacgaaattgttgttcttttgttaacgcctctttttgaagatattttattttgtgactgtgctgctgttgcataaaatgtaatctttcattaatcaatttaaagacagaaatgattttttcaagacgtatacggtcattcttttccaaaagttctatctttccttttaattgtttgtattgctccatattttcaagatttttgatatcttgaaaatccggataaagcttggcaaaaccgttttgaaacatcgaaggggaatggccacatttcatttcttctagtatgaatttaccaaggtctttctcaaaaagagaaagattttgcatatagctgtaaacatcatttaaccttttctcgtaaaacgaaccattatcatgtaattttttattttcatcttgagaaagttgcaaattgcttttcagtatttcaacttcagatcttaattttactatagagttattcgattcgttaatatcttttagaaatttatcattttcttgctgcaagtttaggatttgtttttgcttcctgtatagttccgaaactaaaatatttctttgagaaaaagctttacatttagttttggcactagtcacttcattcttctccttcttgctagcgtttttgttttgaaagtctgtaattttttcttctctaatttttttaatttctttgcgaaaccggtcctgaacaatgttgagcctttttgatgcagcttttctttcgttgtggaattccttctgcaagtcttctattctttgaagtttagcatcattcatgctattaagttcttctagttcttgaatcctgtcatccttctcttctagtttttgtcttagtgctttgatctcttcattttgggactggagctcatctaataccttgggtaaactattttctttagaaatacttcctccatatgatgaagaagatagcctaatttctcctaatttcatatattcggactgttcttcatctggagttttagatgagcgaaatacgttctctagatgcgcaacctctatattctcctccagactctcattgcttacaacataatgctcatcatttgagattgctgcgactttgtggggattcgtgaggagctttgtaggtgtagaagaaaatctattcacttcaatactattgtgtactttgtatgtggtaaatttaccagggcttacatttcctaatgtactgggctttcctgcaggtgacagagcctgcgagcctattcctacagttggtaaaccacccctttgtagaaatttattaggcgattttaaagtatttttttccgtagcattttccaatgtactaatgttaccagaaggtgaagaggcttctgaacctgcccaactctctgagcggtttcttcgggaacgcctattcgacagttttgatataatatcagaagaaatactttcctgcacattagatttttcagtggacgtaggtacttcagagtctatccaagtttgtgaacgccgctctcgaaaaggtttactttctggagacttagttaaagtgccatcagtaacatgtctcatctccccctgctggtcgcaatccgagttttgttcctttagggattcaggcttattcaaaaatgctaaccaatgattcatattcggagaagtttgttgtattcaactatcccattcaaaatcccaaaccgagttttgcaattctttcactggcaaatctctttgtgttcctaatcttaatattgtacaatgggcggctaaagcgcgatacgcaaaagaaatttgtacatatactcaaattactcattaatacttggaacaagatatagtagccctctaaacatatacaactaaatctggtagacttgctggccggctacccaaactttagtggtgttgcgatcatcaccgttaaagaaccattttgcgattatgtcttcattagtaagcagcggtgggttcttataagggtcttgcccttgctcttgctcttgctcttgcatttgatccttctcctttagctgccaatgaaacatatccacgtttgagccgggagcattggtatcgatcatttgagcgtcaaactgcttaccgacgtcaaaagtccccaaggtctcatccatacgcaagacttgtgctccgcccattgtagcaagaaataggcactcggagactgaaagttttgcatgatcagtttctctcattgccaaatgccttgaaactgcaaaggcctgccttccggtggtgagtatgctacaagaatgaccggctgaaacgtcggtgcctagaccaacctttatgccctggtccagcaaccatcgaaccctacactctccagaagtcagagaggagttggaaatgggacaatgagatataccacagcgacgctgtttaatcacacgcgcttcggcatctgttagatgaatacaatgtgccaatactgttttttctgtgagcagcccatatttgtcgtatacatcagtatagctctcacattcgggaaataaatcttgaacccactgtatctcctccttattttccgacaagtgggtttgaacgtgtatgttttcatccttgactagcttggacaactgttgcattagttctctagaacaagagggcgcgaaccttggtgtcactataggatttacgaggggatcacaaatggtttcccgtatgtacttaacaactttcacagtgctttcaaaggaagttttagtatcttcaatataatactcgggaccattggtatccatgcacacttttccaacaagaacacgctgccccaataaggagcttagttgagccaagagcttagtggacttgagatcaatggtattatagtaagccacagtcgttgtaccgtgagaaagcgtcttacttattaccttattgtaaacttctctcgcaatattttcgtttgctagtgcggcttctatggggaaggtatacttctctagccaatccagcagggtagaattcccaaatacgccgacatttggatattgcgagacatggttatgcgtgtcaacaaaacctggaaaataaaagctgttatttcgagtcttgtcttttccaattatgtcaaccaccgtgacatcctctggtgataagctactatcgtgatctaaacaatctttgacaggatcgagtgaatttctgttcacaaacctgatgattccgttgagaactccaacagatgttttctctctgattctcagctctcctaatttaggggtatctacaaaggtaccaaaaaaaactagaaactttccatgtttgtcgttgaatttatcaaataataaatcactttttgtcatatcctcttcaaaggacagcccaattcatatattcattcaataaaatgttgttcttttgccaatggcctgttttaaaatccttatcttgtctccttttataatccgaaactatccaaacttccgagtgataaatcgccggataggcataaaatatgactcgagataagaccaacaaagataagtacctcggtttagttaagcgatgttaggactgaaagggtgtctaactattcttattggatacgttattgctgtctgtgctttgttttccagtaggggaagaaatccttcattaactgattgggaaaagttaaaggaccagaaaatatcggatattgataactttgggttgaccggtcaacatcttttagaatttttccaggaaaacttgccatttctaagtttttcagaggaaaagtatcgtcacaaacacgtttctttatattatgatgtattcaaagaatatatcttacgtcgtgccagttcaaaaaagtgtttaccagtagactctgctatcgcaaagttgaacaaagatgttaacccaatgccagttcactcccataatgactactggaggaaacttccgctttttgaaggtctggcctatggtgctagtagtactgaagccgacgtgtggaatatagatgaaaagatcctagctgtgggtcataatgaagcgtatttggacccagttgaattgacattagacaagctatacactggccccctcttggagattttagacgaggtgaattgccaagattcagacgccgatcgcaaaaatggtgtatttttcaactctccagaaacttcactcttcttttatattgatttcaagtcggatgataacgaactaacttataaactgctgatggagcaatatttcaaatctctgattgattctggatatttgacatattacgatatgaagaaggatgaaattatttggagacctgttactgtgatactaacgggcaactacccgacgtcattggatattttagacaatggaaatgataacggctattttgagtcaagtcaaaggtttgcatttctagatgcgccgttgttaagtttggagcccaaatactcaaagctatctgtagctgcgacggtttcgttcagccaattaatgaaacattgtggttctgatcattggaaagtatcgctaagaggtcgtatggattcgaatgagatcagttgtgctaaaagcataattgatggtgctcacgcattgaaacttaaaacaagaatttggggagccccaacctggccagctaacctggtggaaactatttctcgccaaattattcatgacttgggttccgatttacttaacctggacaatttattcatggcatcgtcattgatataagtggcttgagctgtggataagaaaagccatatatttatataaacatttagatatgaataggaagtagattgttcgacgcaactacccgttcaagaagtataatggggaatggtctcatcttccctcacaggatatagttctctgaagagatacatacgtttgtgtatactatgcttctttatcaactcaagttttgtagaggaagacgttgaagatggtgatgtgacatctttactattctccagcacgttttcagtatttacttaatcgtatattaatgacgtcccttatctattaactttccggtttttctttttttcggtgaatgttctttccgttttagtgaatttttcaattgtaattgacgcaatcggtttataacaagcagacataaatatcaagctcgagccaaatcacaaaaaaagccttatagcttgccctgacaaagaatatacaactcgggaaaatgactgctcaacaaggtgtaccaataaagataaccaataaggagattgctcaagaattcttggacaaatatgacacgtttctgttcgattgtgatggtgtattatggttaggttctcaagcattaccatacaccctggaaattctaaaccttttgaagcaattgggcaaacaactgatcttcgttacgaataactctaccaagtcccgtttagcatacacgaaaaagtttgcttcgtttggtattgatgtcaaagaagaacagattttcacctctggttatgcgtcagctgtttatattcgtgactttctgaaattgcagcctggcaaagataaggtatgggtatttggagaaagcggtattggtgaagaattgaaactaatggggtacgaatctctaggaggtgccgattccagattggatacgccgttcgatgcagctaaatcaccatttttggtgaacggccttgataaggatgttagttgtgttattgctgggttagacacgaaggtaaattaccaccgtttggctgttacactgcagtatttgcagaaggattctgttcactttgttggtacaaatgttgattctactttcccgcaaaagggttatacatttcccggtgcaggctccatgattgaatcattggcattctcatctaataggaggccatcgtactgtggtaagccaaatcaaaatatgctaaacagcattatatcggcattcaacctggatagatcaaagtgctgtatggttggtgacagattaaacaccgatatgaaattcggtgttgaaggtgggttaggtggcacactactcgttttgagtggtattgaaaccgaagagagagccttgaagatttcgcacgattatccaagacctaaattttacattgataaacttggtgacatctacaccttaaccaataatgagttatagaggagcaatgcaaaatctaggggtagaattactttttgaaaaggaaaaatattcaggtttgttgtttttatgtaagttgtatgatttgatatacatatatatatatatataatatatattgtacatgtgtttttccggggaagaatggattatccggaggtgtgaataaaatgatgacgattataggtttgtgttgtaatatttagataactcaattctcgccagtttgaactccaacctagactggttcaaagcttttgctatcaagatgagatatatggaattttcgtctttatcgtccacttgtatctttatttcctcgtcatcttcatcaatattgattccattaataatcgatttatcgctcagagtgttgaccaattcggtcttgttggggaagaaatgttccatttttcttcccaagttttgaattctttcacaaacccaggcaattctttgtaagcctaatgcagcagaagaaccctttaaaaaatggcccagattgtctaattcggtaagatttttttcaccgtccagctgtcgttgcatttgagcaaaagttgtttgtgcctggtcgataaattgaataattagacctttagaaaaatcggaatcatcgtcatccatagatataatttcatttaagatggtccaattgatgatttctgagggaatagtagacattattgtgtgtattttcttgtttccgagaacgagtgttgttatttcttttgaatttttcaaagaaataaaactattacacgtcagtggtttatcaatgatccagagcacaactatcgaccaacccaaccggtttagaaattaaaaacaataatgttcctaaatataggttcaattaaatttgataaaaatattaaactttttatgtaatttttcttcagtttttccgtttcgggcgggttacggatgtattgatgattatgtggcataaacgaattatatctccggtattcaatatgtaaagttccgtttctatttaccactatttaacggaatttttgctcctttgcccttcatgtcttatgataggttttttagaaagaagcagggtcaacctctcgctctgacaaggcaatacgccggtagaggatgaggatgaagaggaggatacgttttgtaaatctctttccatgacgtgcatcattttctcaaacttcttgaacaaaagctctgctctaaccattaggtcattccaatccaacttcccgttaagttcattaaaaaattttaatatttggtcgaactgatttagatgttgtaaaatagcttgtgagtttttctgtagaatggccaacatgaagaataattggaattgtgaactgtagtagaaagtccagaaattctcccaaatgtgcataatatcttccatttcaaattctctcttgaaccatactagaagcattcgaaagcaaaagaacaagtttcctgaatcacacttgtttaaatgttcgctcaattcgggtagcattaattgtaccaattccacgagagttaacatttgttcatggatgccactctggtctcttagaaaatttctttccataatgtccatgaagtgcgtaaaacaccaaaacgttttccattcttccttcatgatgacataaataggcgataaaagatcggtcatcccctgcacgtagcctaagtttgtgttgtagacattataagtgataagaatgttttgtaaatgtatcaaatgtgggttcctgactccatcgtctgcatcatcgctctcgtcattagcggattcggggctggtactgttattttcatttgctgggagttgttgtggcggtggtggtaatccatcgatggtattgtattgaaatatctccaagtttctatcacagcgtctcacatctttagatattctgaataattgatcgttccaatattcctcttcatcttcatcgtcaaattgtaaaaaatcttttgaccaggttagtttcaattgatcgtattccgcggctaaagtttgatcgatttgtaccctctcgtcttgagaagaatcccacggatatatttctaagagaaaaccccaaactttccctcgcaaactgtcattttctaacccaccatgaaatatgaaatccttaacttcgtttaccgtgaccctcagcctcccatcgttctcatcccatagcgaattccatttcgcttccgttaaaggaaattgtctttgcagagcattatttatttcagtatcacttaattcatcagttagattcaggtcgttgaaaatgttattcctatacgaatcaaagagtttgttctgcttttgatacctctcagcttcctgttttactcctaatgaccagtttgccaaatacactcttgcagagtcataatcctgttcaatttgtttaaccttctcattgttcagaagcttttgcaagtattcattgtcgatttgtgatttttgtatgggtgagttgttagtcagccaactatcgataaaattggtagacttggtagtcacgtctgctatcttgctcattacgttccatttccattcttggaatttctcgtttagtttcacaccggcggtagcgagttcagttgtatctttcttcgaattgttataactttccaatagatccttggaaacgaaatttctcaaatcattcaaagagggatttactaaccaaaactctggctctaagtttgatttcttgagttccatcagttcgttgattttgtttctcaaatctacgccaccccaatacaattcgtccgagtcatcaaatgggttcatggatttgcgtagtctttttaacttgtccgtagttgatgggcagagttggtcatgaaagaacaagacaggaggttgaaagcccgtaaactgttctgtcaagggatatattaccagagatccgacataccaaccatttggactaggaggcctaaattggatgcagtatatttgtgagagagaaatttcgaaagcttgacctaaagaagtattgaccaggttactaaagtttattgaattttcaataacaaatggtgtagaagttggacatgtgcccactttagcttcatgttttagtagttttgatatctctaatgtggataagccagattctgggatatattggagaattgcttggtgggatagcttattcgcttccaatgtgagtagcaggaaaccagcaatattatctctagcatcgcttgttgggtgtaagaacactttagatttgcagaatagtatcttactcatcaggggatgtatgaatgactcttgtagaactttgccaatttgtgcaacctatatctgagaaactgaatagtatatttgagcacgataaattgatttatatctgaccaatttatggaaagttcttaactatttcttgcaaatgcgcctctctttatatagagcagaactttgccccatatagtattgtttaagcctctcggatttcttttctcatcttgtggggcttcccgcctgaactaaaaatattaactatggagcaataaagacaacacttgacactgttcatggggcagaaggaaaagcaaagattatctgcaatatgtaccaaggcccaccgcaaccgcctcctcaagctgtgccgatgccttacattgtgaataataacacaccaccgtacccaaatggtaatattaactttcctcccaccgcgcagcagaatataccgcccacggtttatccacaacaagtgccatttccaggtcaaccacaggggggtcaatttccacagccttcatcagaacagcaggtgtttaaccagcttccacaagtgactcaaacttttcacaactctgcgcagaatacgaatgcaactgggggccctggcagcgggtctatgccaatgtttacgccggtagcatcctttccccatcccatggctacagcagcaacggcagctgctccgttaccacggtctgcatcccaggcatctttatctatgttacgggtgccgtatcatgtaagaaaatacttatctaatttggcgatgttgaaattgtacgaaataataaatgaggtgaatacggcaatgggtaagattggcctgctttcattctggacagaattaatatcagatatttttacacctgatgcagttataaggtatagtaaaaagtctatgacagattatagagaattcgaatttatcatcccagtgttcccagttatttgctctacattaggcagatttggcatcgttagaatggaagttaaggttttacaattgaaaacacaagttctaagtaattctacgatttttttcaactgtcctcgtgtcacatttgtctattattatcctgatggttcatatattacacatttttcccaaatgaaaggtgctttcgatttggacttgaaaattaattggctggacgtatctatgcatagttttgtccctgatattgaatggaatgcagtggaacggcttttgagtgatgacacaaagtctacagaaattgaacaaatattccgtaaattgaaacaagaagatgtcaaagagcaagggaattcttttgcagaaaataatgctacgaatgttcctccgaattttgaggccatcactcagctgagatcatattttgacgtattcagaaacgtctctgtgtttggcactcaagaagggttgatgagagtcatgcaaataagtaccgttatgtctactttgaaaaaccttcgaaagtttcaaattgaaaagaacattgatagtcccgtgaccgccctaagtgcgtacattgacgccgacaagaaggacagtggaagcgagcccttgcacgcaaagaggcgacgcaacagcggtatctctcctcgcaccacgacgttggggccaaacggcaactccaatacaagcaatgaagagcttccaacaagtgatgtgaatgatattaacaaagacatgacaaaaaagaagatgaagttttaaagaaggtaattacctaacgtcacccactgaaatattaagagaattgcatgaatctagcagaatgggaatgtgacatggtagcagcaaccgcaaggtgtggcatagattatagtagtgacaaaactgtacaattactatatagtgagatataatacaatggtttattcaagatatattaacccccgggtaatggaccaaatttggaaaagtctcggattctcataaaagcttaataaataaagagtatttcgaaacaaacacgacaattacacttgcaagtcagtagagaaacccagtacagagcaagcaaaagatgatctctgatgaacagctgaactccttggccatcaccttcggtattgtgatgatgactttaattgtcatttaccatgctgttgactccaccatgtctcctaagaactaaagtggttacatttggatagcgaacttcagtttttattatacgtcgctttgtgtttctgcaaaacaaaacaaaactacaactacaaagtactgcgttggatttcaatcagtgctacattaatttttctccctttttacttcgttttacgcacaaaaatatacagataaatacactcgagataaacaagacatctccttccgctattttttgtataatttaatatcattattaataaaaagaattcctatacatatattcaaaaacaaatgttaaaagttttcttcgcccagtatatcttttgcacaactctctacctggaacaaggcttcagaaatatccgtaaaagctctcgcaaatgcaatgccgtgaacctctgtccaatgcattttttcactgtctatttcagagctgttcgccactgaaggcaagggtaattgttgctgccctgaacttgatgccttctgttggtatattttcttgaataggttcttctccatagaattgcctcctgaatttaaattcgaatgtgattggtccttcatttcactaaatttcttgatgaagtggtaaagttttttacgtgacataattggatttggcaagtatcgcggtatcttgttttttgatctgaaacaattggataaaatgtaaaaaacgaaaatcactgatgagacactatctcttcgtagcgatagtaaggctctcgtggtttcaatatcaaaatcctgatcccaaatttcaaaaaatgcacctgaaattctcgcttcaatgatcttagataacaaaaattggcatgaattgattagacttgcgtacttctcaggattgaagttggaaataatgattggctcatgacgggctttcttcaaaagttccctgattgcttcaagactttgagtcagtctaacttcacgaatgtgggaaaatgcgaaagttaaatcagtaggtgcgtcgtcggcatccctgtataaataccggtccgccacggtttggtaggactggcccaagtgtgccagtaatgatgacatactatctcttagttctgtcctagctctaaagggccacactatccagttgatgggaatcgaaaccaaaataccgataataagtgccaagcctgtaacccacgtagatttccatattccagcggtggttaagttataatgtctattaggtttgctgtatggttcaagagcaattatggtaaagcacattaatgcagtgaagctcgatttggtgtttctatagacaagaaagttgatgctaaatgggaccacgatcagaccagcaaacgtgcaaaccacgtatggactaccaaaatgtctcgattggttggcagcccacccccaaaagatacctactataccacagattaatctcctcattaccaacgcccagttaccagagtatcttctatgtgctaataagtaaaacgtgagtggggcccaccaacaatgaaattcttggtaccagtgataggattcaggtagccaagttggtagacacaaaaatatcatacaaaaagtaatctttagtgtccacttacattcatcaccagataaaattctactcaatttccatagtttaaatctccaaggattttgagttgtatgaaaattgaagtcgttgtgatcaattgctctgatggaaatagtgtggtttttgcgattctgtgacttttcgtcaccaccttgtgaatcaagtctcagcgcttcttcttcgcctttgttatacttgtgtcttgacgtgtaggtgttataaactctttcaaaaatttcatcgacatcacgtttggcctcaaaataatgaagaacatttcctgcaccttcatcgagaacacattgtttgggcaatcttgtcaacgcacgagacagtggatatgatggcagagcaattctccagtgaatattctcacccaaaacttggcaatcgtggataacagtaactagctgccttgcggagtttctcaaatatcttagaaaaaggaaaatatcgacagactcttcgtcattcaacagttcctgtgaaaaaaaactagaattcacaaaatccctgtaacaaacatctagtttgtaaattttcctctttaatttagaatgcgagtgacttaatattttgacacactcatctaagttgtttttttgatttggagactcgtatttctttagtactcttgatagattttccaaaacgaagatcatttccagtattaagttgaagatgcttttcgagaaggacgcctttaatgcattaatgtagatttcattttttaaaagccccggaccgataggcttaaaggcactgggcgtgttttctcttgttggaattcctgaagattgagggctagcgcttgcttctttgctcagggtcgcagaatccgatctatacttctccaattcttcatacatctttttcaattcatcatcattaaaaattttgggtgcaatgggtaatactctcagagaagtttccatggcagttaaagaatttcttaaactcttcaacgattgaaggtcaaacctggaaattgtcaactgatttacaaaatctctaaaaccttgagataaatcaatgtttagtgttttcaccatttttacttgggctaggtaaatttgttctttggactttattaattcagtatctactagtgccattaaaaaggtctttgtggtctgtagacacttgttataatgttccattaactctgcattgccactatgtggtgatacacatacacaaaccaagagagatagcaaaaggccgaagagatatgagattccaaaatcccaaaaaatttgccacttcaaatcaaacttggatgaggccaaccgaactgtatgagtgaatataatcgatatcgaaaacgaagttgtgaaatagaagaaccgacggtaaacagaccttagccagatggcaaataagagggccatagtcagactctgaaataaaattcctccctggtagtttgcggtcggctttgtcgctgtggaaatgtaccatgccaaagccgaccatcccaggccaaaacttgcgccgataatggagcttatagtcatttccagttgaacaccaatatttctgaccggatgatgtataagtactgcgatgggtagaaaatacctgaactcatggccaatccacctaccagaaggcctgataacgcaaatcacgatagcaatgaaataagcaataaaaaacttgaatatggataccccattttttctaatatctctagggaaatgaataatgggcctgtagatagcagtccaaacatattcggaaagcttggtaaaaccagattgcagttttttccttgcagcgccattgtcgtcatcgatgtcgctgttaggagacctagctttgctgtccggcttggtaaaagcagcatcaaaaaacccatctctcagctcttccagcccaaagtcctctacttcctcccagtgtttgtccttaaccaaattttccagccgcatttgcgataaggatgccacggattgttgtgggcttcctgcaaagctaagcccgcttataccggcaggattcttatagttaagttcatgtagtgacctgagtgatgtttgagagtatgaacctttcacaatatcaggatcaggagtgggacttcgatctcgctcatatcttttcatgaggacctgttacaattccagcactatactgtacatgctttccttagtggagcacaaagcaagttaaaaatgaactttaaattgattaaagtgttagtgacgcttaaactcgttttcctgcgcgtatttcacgcaatctatacataatcatctttgataatgttatatcgcctttcatttccagattttgttcactgaaaagtcttatcggaaacctaactttgggcgacagggttattgtttataatttgtaggtgttccatttttttctttgtacttttttaggttaacgtaatatttaattaggtcatttttagggcgtttagtattagaaaaattcatttgtacacactattaagaggaaggcaaactatatttacattttattgaggaaaagggttcatcgaggagttatcaagaaaagcgtttgttagtagtagtttgcgacagtggagatggcagctgcaccatggtatattagacagcgtgacacggatttattgggtaaattcaagttcatacagaatcaagaagacggcagattaagggaagctacaaacggaacggtgaattcacgatggtcgttgggggtcagcatagaacctcgtaacgatgctagaaacagatacgttaacattatgccgtatgagaggaaccgcgttcatttgaagactctatccgggaatgattacattaatgcctcgtatgtcaaagtgaacgtgccagggcagagcatcgaaccgggctactatattgctactcaaggtcccacgcgtaaaacttgggatcagttttggcaaatgtgctatcacaattgtcctttagacaatattgtcattgtgatggtcacgcctctggtagaatacaatagggagaagtgctaccagtactggcctcgcggtggtgtagacgatacggttagaatagcatcaaaatgggaaagtccgggcggcgccaatgatatgactcaatttccctctgatttgaaaatagagtttgttaacgtacataaggtgaaggactattatacggtcaccgatatcaaactcacacccacggaccctcttgtaggacctgtcaaaactgttcaccacttttacttcgacctttggaaagatatgaacaagccagaggaagtagtacccataatggaattatgcgctcactcccacagcttgaattcccgcgggaaccccattatcgtacactgttccgcaggcgtgggcagaacggggacgttcattgccctagatcatctcatgcatgataccttggattttaaaaatattacagaacggtcaaggcattcagacagggctacagaggagtacacacgggacttgatcgaacagatcgtgttacagttgcgctcgcaaagaatgaaaatggttcagacaaaggatcagttcctatttatctaccatgctgccaagtatcttaacagtctttccgtgaaccaatagacagctatataaaagttcctaattgtgcattttttcaataacaatacttattcatccttataattatattctagcttcgttgtcatgggaacatagcccatacaccgcagttatttatgatcatttcgaacgggaagtatggatgaatctttttttttttttttttatagcacgcaactgaaaaaaaaaaaaagaaaaatttttcatcttcgctcgacgtttcttttgtagtactcatctctttttatataaagattaattagttattgtcgctttgcttttccttctttaaaaaatgtttcttgcttttggattttcagatgtcccaagatcattacagtattttaattgaacaaaatggctgaaggtgttttccaaggtgctatcggtatcgatttaggtacaacctactcttgtgttgctacttacgaatcctccgttgaaattattgccaacgaacaaggtaacagagtcaccccatctttcgttgctttcactccagaagaaagattgattggtgatgctgccaagaaccaagctgctttgaacccaagaaacactgtcttcgatgctaagcgtttgattggtagaagattcgacgacgaatctgttcaaaaggacatgaagacctggcctttcaaggttatcgacgtcgatggtaacccagtcatcgaagtccaatacttggaagaaaccaagactttctccccacaagaaatttccgctatggttttgaccaagatgaaggaaattgctgaagctaagattggtaagaaggttgaaaaggccgtcattactgtcccagcttactttaacgacgctcaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttccaccagaattccaaaggtccaaaagttgttgtctgacttctttgacggtaagcaattggaaaaatctattaacccagatgaagctgttgcttacggtgctgctgttcaaggtgctatcttgaccggccaatccacatctgacgaaaccaaggacttgttgttgttagatgttgctccattatctctaggtgttggtatgcaaggtgacatgttcggtatcgttgttccaagaaacactactgttccaaccatcaagagaagaacctttactacatgtgctgacaaccaaaccaccgttcaattcccagtctaccaaggtgaacgtgttaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctctaacgctgttggtagattgtcttctgaagaaattgaaaagatggttaaccaagctgaagagttcaaggctgccgatgaagcttttgccaagaagcacgaagctagacaaagattggaatcctacgttgcctccatcgaacaaactgtcactgacccagtcttgtcttctaaattgaagagaggttccaagtccaagattgaagctgctttgtccgatgctttggctgctttgcaaatcgaagacccatctgctgatgaattgagaaaggctgaagttggtttgaagagagttgtcaccaaggccatgtcttctcgttaagactgcattcatcacatatatatgaatattacttatattgtatataaattttgttttctcttaactttgtatccttaataaaataaaattcacaagtatcacaattaaaatatttgtttttctttcgcgtaaatatttagcttgataactgttactgatatgtctgaggaaagttgatcaagacccaataataatctatatactggttgaaacaaatcagtgccggtaacgctttttgtatcttgagatggcgtatttctactccagcattctagttaagaaaaagtctaaaaatggtttttttcatccaaaatattaaattttacttttattacatacaactttttaaactaatatacacattttagcagatgcgcgcacctgcgttgttaccacaactcttatgaggcccgcggacagcatcaaactgtaagattccgccacattttatacactctggtcctttaactggcaaaccttcgggcgtaatgcccaatttttcgcctttgtcttttgcctttttcacttcacgtgcttctggtacatacttgcaatttatacagtgatgaccgctgaatttgtatcttccatagcatctagcacatactcgatttttaccactccaatctttataaaaatacttgattccctttctgggacaagcaacacagtgttttagattctttttttgtgatattttaagctgttctcccacacagcagcctcgacatgatttcacttctattttgttgccaagcaagaaatttttatggccttctatcgtaagcccatatacagtactctcaccctggaaatcatccgtgaagctgaaatatacgggttccctttttataattggcggaacttctcttgttttgtgaccacttcgacaatatgacaaaacattctgtgaagttgttcccccagcaacattacagtcgtatgtaaattgacattggacttttcttccttcaatgatttcctccctagctgacctggtcgtcacagtagctgacataccaagagatcttgaaatatggacaattccgtccataatggatgaataaacagtttgaattgctattttataagattcagggccttcgccctttttcacaacgtacccatctgagtcgatcaagccggctaagaatgcttcacgaacttctatatgctcgccgtacataaattcagggatttgcttctctccatcaagatcccttttaaactttaaaattgtgacagctttccagaatggattatttttcctcaaattccttgtcttcctgttttcatctggaccatctccataatgaagccttacatgtttggcacgtagcggaacgtgatcgtcacaaaccgtaaggtagagaccccagattttcgcattttctcttaaactctccattagcttaggatccaagctatctactgagatttctggctcttttgttgtactgtcacctaaccacagaccaagcatccaagccatactttttacagcaggagttacaaggtcactacgtccagtgagaaatttagataaaacaccatttcctgcgagtactggaccaaatcttatgcagctagaaattctcaattgagcatcaagataatccaaatctctaacttcaatgtcaaagttgaaatattctcctttagagcgctccatttcttctatgaagcgttttgcggcaaactcaccttcaactgtcattgggaatgtcttatgatggttttttggaattattattatcctaccatcaagcgtctgacattgctgcagatttctccatctcactttatatttggtggcatttctaccacttttttccaacagtggtttggtagggaccctgactgacaatttatgacctgcagtacattgtaatgcaagacgctgataaactgttctacgcctgggatctaacctaccaggttcaccttcaaaagctctgtgtttggttttttgctgtatattatagattttctgatagccctgtgtgacatttatgacgcgggcagcggagccatctgcgcacataacgtaagagttagccgtgacgtttgcgatgtctttaatttcaccgttagccatcagaatagtcgtgttttcagaaagcattttaaagtatagatagaattgattgctgcttatgaggatatggatttagagctaatagttgtaatagaaataaaagccatttagaataggaattgaatacaattttatgagctttaaatatttaatgatgaatagtgcgtttagaacgcttcatcatgcttcaacaagcttctgcaaacctcatttgagtagcaatagctgtttacttttttccgcgactttattcgaagttatggtgaacttttcgtggtttcacacctaataacgcccagcggtagtacaattcaaagtagtaggtaccaatggtagtactagtgggtgatagtagcaaatttctctatgaaaatgaattgttgctctgcaatgatgttaatgtggacatgacatgaattttcgcgatatgttgatgtaaataataacatgattttcgtggatcatttcgtaaaccataggtttatttcgtgaattactaagagaaaggcatagaaacaggacttgcgaaccctttctgtaatatgtcataatatttcaatacacgcacaaaaaaggtacgttaatttccatggtaatcgtgtatttagttacatcacttttcgtgacacacatgaatacatttgcccttaagccctgtgtaggattgatttcttttttcgtgacgcacatgtcttcaactgcatcaatttccatgagacacacacgtctaccatgttgtcagatctcatgaatctttcatgtattcattcacatcattttcgtggatcctctaattgtatcgagatcacttttcgtgatccgctaatcagcgacggtcacattaggtttgccaagtcagggtatgaaccatacgatcagttttcgtgaacctggtacgtatattgtggcgtttgtgtatattttcattctttgacaacaatcaataccaacctcaaataggaaaagtaataagtttggcgttacaccccaaaagacgccaaacggatcgaacttactcaatagcaattagcgagacaaaacctacgttaagacctgtaaccgatttatcaaagcactctgcggttctttcttgggaatattacctggacattttgtgccctcaagaaacgaggctctacgagcctgttggagcccctcagacattagccgccacgaatcaaactttttacgcgattcggcccaaatcagtttctcacagatcattcgtagagtgaaaaagcacatcgattatttgatacccctttgggttaattactgttgaggtcttttctatttctgattgaaatttttgctccagcattatagcatgctggttttttttttaaattgatgtatctcatcgcaggcacgggcagtacagtgccctgagcgtagggaaaaatgaaaaaaaggatgtaacttttaacataattccagcacgcagcgattgggtataatgaagattgttaagttcaacaacatgtgaaattcttagctccgcaacttgcttgaattatgagctctaagattcaagaagtaaataggtcatataatggaatgatagtagtacttgataaaggaaccatgtgatcttacgttgatatgaaaataattctctcacagaagtcagtttgtatgactaacatagagagtaattgcttttcggataaaatcgcacctaacaaagattaccttttgtaaagcctccagaacagctatgaatgttcgttattctacgcactttctttcatacatcttgatccgccttttttgatgtaggttttaacgcggcaaaacatattaatttttctgatttggaaaaataaagagttagttctgccacgccattttaagtccaaaggcacaattttacgttggaactaaacggtaaagatcaaatatcacctttattcttttttggtatgcatcgatttctttgccagtaagaactacgtgcaactctacattagatcaaaatataacggatcataaatgcaaacaacatttgtccaaaagaaacaaaaatgttggcgtttgtctcgaacatgacacaatactccttgatcgagggacattgcccgattaactatgatttatactttttactacaggtactcgttctccctactatttcaccagtatacggtcgttttatgattcatttattgcctataatggtaaaaagggacatcttaaccttacgtgttgcaatgagaccattcttttcgattcatcaactgtgaaatttctgaaatccagtacaatgcgaaacgctaccgataatggcaccgtcttttgaattatgaggcccagatatggcgttcaatcttcaacaaaaaaatgaatatcaaaactaaattctatctggataacaatctttctttggtttgcagaaatatcattaaaaaacaatccataactactaaggaagggtataaatggtttggtttactaattttatattttgatttgattagcaattataatctctaatatactatttctgtagccaaaaatctgcaatgtcaataagtagcaagtgccgcttactcgtgagaatatcaaccttatagcatatgttttctattttttttttttgcttatggagataatgaacattgtacacatgaacaaagtggtagttctctctccttgattttttgtgcttgcgatatatataattgttacattcaatggccatgctaaataaaggttttagctttgtttcactcgtgcccaggataattttaaggcgcaaacatccaaataatgaagaaaaggataacgattgtcccaggtctaaaacattttttaataatagccgtcattagccttgcaacagtacaacaacgccgatgggaaaggattgcaattctatttgtaattaataggttgtataataatttacgatatggccttgtggtaactatttatgaatactggtgtagacttatttataatcctagagagtaaacctcttcttgtcaagatatgaaaaatacaaatttagagacagaagtattacgtgtaaactttacagaaccacttctccattatagctacaatgtgaattgaactttccttgaatgttgagaaaaactatattaaaattagaaatcgtcccatttgtcctcgtcctgttcattcttcttatcgttattatcaatcttttgatattctgtatgggttgtattccctgctgtagagctatcctctgcattaccattgaaatttttagtgaagttactaaatgcttggaatccataactactcgtttcttgaaacttttggccaaactgggcagctgctctcttcgtttcttctgacaactctccggattgccattgctggacgtgaggcttaataaccgtttcgtttacgtcctcgaacgatttggttacagcgctggagaagaggccccatcctctgctcaatgttcccaaaggatcagcttgaaaattttccaggctcaaagtattgctggaccctgcagaccgttcttgtggaggttttgcgggtgtacttccaaagccctgatatttaccaccttgagaagggggcaaatgatctggtctagattggttcttcttgcccagctcagcaaaataagcttcgttcttctccttttgaaaattggcaccattactagagtttgctggtgttgcagatcgacggttctccagtggtgtcccttctcgactttgagcaacaccaggcgtagcggatgcagcggtttgagaggttgctgataacttggaagcatcaaaatccaaatgctcacgctcttcaaatactctatcttcgcaaagacatgttaacttttctttataatcctctgcgacggggttatcgtatttcactttttgtggtaaactcaggtcaatattatgcgacttgaaccattcagtcaaaggttcgttaccacctttttccatacgaagaagttcctccggtttaaactgatccatagtgatagatcttacaaaagatatatgcacaccaagccctctatggataccggcacattcaaggcaaatgaaagctccaaacttaggcgtggcccattgtggatttggcgcaccacaatccatacatttcttatttgcaccaatcttttgcaattgcaaaagacgcctgcgggtatctgggtccactttccaatctgacatgctctataatccgcgataaaattgctcaattggcaccatttaaactcagaatcacgtccatatttctgctttcattcttgatatagttgtgcaatttggttcttgacaaaaactggcgttgcttgcgggtaaccgcgcgatttttaaagtgccaaactgcgaaaagaatataacaagctttcgagcaagatcaatgtacccagcaagtgaaataataaaacaagagccccaaagatctgcttataattgctagaaaaatatattattaatcatgagcactgcttcaacaccgccaattaacttatttcgtagaaagaaagaacataaacgtgggatcacatacacaatgttactatgtgggccagcaggtacaggaaagaccgcctttgctaacaatctattggaaactaagatctttccgcataagtatcaatacggtaaatcaaatgctagtattagctctaacccagaagtaaaagttattgctccgacaaaagttgtttcatttaattcgaaaaatgggattccatcttatgtttctgaattcgatccaatgagagccaatttggaaccaggtattaccatcacctccacttcattagaacttgggggcaacaaagatcaaggaaagccagaaatgaacgaggatgataccgtgtttttcaacttgattatgacgcatggtataggcgaaaacttggacgattcgttgtgttctgaggaagttatgtcgtatttagaacaacaatttgacattgttttagctgaggaaaccagaattaaaaggaatccgaggtttgaggacaccagggttcacgtagcattatattttattgaacccactggacacggtctgagagaagtcgatgtagagctcatgaaaagcatctccaaatacacaaatgtactgccaataataacaagagctgactcattcaccaaggaggagctaactcaattcaggaaaaatattatgtttgatgtggaaagatacaacgtcccaatttacaaatttgaggttgaccctgaagatgatgatttggaatccatggaagagaatcaagccttggcatccttgcaaccatttgctattataacttcagataccagagatagtgaaggtagatacgttagggagtatccgtgggggataatatcaatcgacgacgacaaaatttcggatttgaaagttttaaaaaacgtcctgtttggttctcacttacaagaattcaaagacaccacgcaaaatttgctttacgagaattaccgttccgaaaaactatcgtccgtggccaacgctgaagaaattggtcctaattctacaaagagacagtcaaatgctccaagtttaagcaactttgcctctttgataagcactggtcaattcaattcttctcaaactcttgcaaacaatttgagagcggacacaccaagaaaccaagtaagtggaaactttaaggaaaacgaatacgaagacaatggcgaacatgattcagcagaaaatgaacaggaaatgtctcccgtgagacagttgggtagagaaataaaacaagaaaatgaaaatttgataagatctatcaaaacagaatcttcaccaaaattcttgaactctccggacttaccagagcgtaccaagttaagaaatatttcagaaaccgttccatatgtcttgagacatgaaagaattttagcaagacaacaaaaactggaagagttagaggcccagtcagctaaagaattacaaaaaagaattcaagaattagaaagaaaagcacacgaattgaaattgagggaaaaactaataaatcagaataaactaaacggttcatcatcttcaatcaattctctacaacagagcacaaggagccaaattaaaaaaaatgacacgtatactgatttagcctctattgcatcgggtagagattgagttgtatctgtacaaaatccaaagctgagcaaataaataaataaataaatgtataagttaccgaacgggggtatttttacttttgatcaaaaatttatgtaccaactacaaagtttcctcagcacagccttcaagaagggaacacacatacaaacagtgtcaaataattgtagggataaatttaaatatggcataaactaaataagtagagcatgaaaaaactgcaaaatccaaaaagtaaaaacgaaggtcagaaagtaaagcaaaagaaaattaataaagcaatactaaatctatcatgatttcccgtaacttccattaaagctgtaaccagatttactcctactgtttgagcctctaacgcctaatggatttttagagaagctcaacctgatacctcctttgttgttgagggaagggcgggggtgaggtagttgactaccatataattctgccaatgctctagtggcaaagctaacatcctcaaattctacaaaacaaattggaccatggccatgaccgttgccatgaccgtgagagttcattttattcctgaaggataatctacgaaaaccttgctgattagaaaacaattgccttaattcttgttccgtggcatccggaggtagattacccacataaagagtattacaaggaggattttggtccgcgggattggctggtggtggcaccttggctagtagtgataggtcagcctgtgaaatagttgtggaacctgccacatttgtttcgttatttttcgaaaatgcagaggcagaagctgtagaagaacattctttctgtcgtgatattgtactggtgtcttgttcactcactaaaaagccttgattcaccttttggttgttgaatattgaagacccgttaggagcagaagattgtgggtggccattttccgtttggagattcaggtccaaattggaaggaacattcgaaacgctctgctgaatactttgtgtcttagttgaagcattaatttggttcaataagtgataatgcggtagagaagtcgcggaatgtattactcctgaattgttcagattaggttgtgattgaatatgtggaacatcctggctaattgaatggtgggatggaggcaacagattagactgatgattttcttggctagataattgaaaaagaggaatattagcagttgaggaagcattccactccatcacaggcgtagatgacatcggaggctcttgtaaagatgcaccaaatgaagaattaccaacatcattaactaattcatcaccattccaaatactttcatttatttcatccttttctagtagcaaaagtgacttgccagcgtccttctgaggtggcattcctgctggaactggtgtggtggttacgtttgataaatcatgttgtgagatgctatttcgtagaaagggtacggattcttttctttgagagattgtttccaatccgaatgggtcattgaatgagaaacggagggatctctctgaaagtaatgaaggccttggcttggccgctgaaggccctaatggagaggaactagtttttccatatgatatagtattaaaactttgattttgaatttcattttgcgcactggacgacaattggtaattctttggagaactatttgtagtgccagatgaaacatgttcttgaaaactcactggaagctgcgtttgttcatttactacgtcaatgtgagacctaaaggggaaactaggcccaaaaatctcagacttcgagtttaatatattagcataatgggttactaaagaaagggatccaaatttgaccacaacgactttttcattgtcattaaagggttctctatcatccctttttagttctatacttgacaccccagttgctagtgaaaatatacaataacactctcttagtgtaatgtcttttggcaaattcctcagcaaaagacagtaggggccaacatccacatcatgtggggctaaagaattgacgtcattcccgttccctttccccgtggacatggtcaaattatgaagcatagaagtcataataggttcttttgcaaaaccttgcgggttctctcttttaatgttagtctcgctgttgctcctaactgcggaaaaactatatgcagttggcatgggatatgttgcctcctttgataatggaacggtttctgaactagaactaaatgccctttctataagaaatttggattcgtttaaattcgtctgattatgcactaatgacattgttaattgagaaaccttaagcgttatttttcagcgtagatgtggcaactaaggttcctgttttcaaaaaccctgcttttttgaaaaatgctcgaaaaataaagaaagaagtcagtcccttgttttagcaaagtgataatttgtgaaatatgacacaagtagaagataaacctttacacgcagaaataacagcggattatattttgattcttagatttcctaatttcgtgaacttttaactaagaaggaaaaaacaattgagatgagatccaaatgggaggagttttgaaacaattgtttgctattatttcaatgatttagtgttgccaccagatgggtctattttctgtaaaactaccggttcgaggctcctgccgtaaccttaattgtacttttctatgatttaatccaaataaccattccattcctctttaagtctaagaaacattaaaaaacaaaaaacaccacgtccgggtaatgaaaatataacgctgggtaatgcacgtgttgataattacatcgtttttcactaatatcgtaccaaacgagatgtttgcagaaagaacaaaccaatattttaaataatcaaaaatcaaattagctattatttctcatttggtgataataatatatacatacatatatatatatatatataaatatataggtatatatataaataacctaagacaagttaaatgagtataaaaaaccttgaacgtaaatgaaaaaaaaaaaaatactagtaaattgacaacataaaagacaaaaataaatgaaagaggaaagtggtaataaagtggttaaaatttgttgtagttgtagataggaggagtccgcgtagacagttattcaaattcaattgaggaagaaaaatagatttcaaagaatactgggaatttgttaatcgagaagtgtttaaatttcactcctaaatccaaaagtaccgccagaaatactttttctcactctacccatgaaactttgtttaccagcctgttcctcaccttgctcgtcgtcatggtaatcttgctcaccctcatcggaaccgtactgatgatgtcttggagtgtgctcggctgaatgagtagaattattatagtcgtagtcagacccttttgaagaattctgtctgctgtgacggtgatgattgtgatgatgttttgattttccggaacccattgaacccaccgacactttccttccctgagaagttgtttcattatgaattgaataggaagtggtttctgggtaggtgccctcagatggcttttgagaactagaggtgttggtgtctttaaatccgtatgttgggacatgtgggtcaatcaaactagggaaattaccaacttcggcagcataagcgtttgaggcgtcggcaccaccaaggtcggttctacgtttgttcttcaaatctacttcacgcttgtagcccggtgcgtcttcctctaaaactttcgcattcttattgacatcaatattatcgtcgctagaatattcttgattttgggaattgccgccagaaccgtaactggccttttgttctgatgatggttcctgatcgtgagtcattccagtaatatcttgtgatttggcatatgtagggtccgcatttttaatattatcgtaagcagctgtttcagcatcccctgatttggagtatgtagtgtctccagatctggaattatcaaaggcagcaacattagcgttttcgagatgagtgtctgtatttttactatcatcaaaagggttcgagctgaaggtcttggattttgcacccatccttccggttgtatctacgtttccagtagtacctgtttccggattattggtgaaatccttggcatcggatgcaatatcctgtgttgtttttgctcttcttggctcaatttggtcaataaaattagaacgcgttggagttgggcctgatttatttttgcttaaatcagataattttttgttaccagaagtattcgagtattcgtaattgccaagactctcatctcttgcagtctccataccagcacggttagtggtttgccttggagacaacgggtcttcatcttgtttttgcactgattttgacaacgtatcaggttcaaaagtacctgggattttctctctctgctcataattgtaatccgatggttttccctggtacgctttcttagaatacaagtcgtttttctttgcatttgagtagtcgtcaatatcattctcgtggtagtcttcaacatcatccaaataatccaacccatattgatgaggtttagtagaatcttcattcatatcttcgtccttcatagcaggtgatacaacattgtttcgggtggtggcatcattagaaagcccggaccattctgcttcatgacggggtgacatgtcaatattgttgttcgtattttgagaaccagcttgtgaaccggcaacatattgcaagttatccctaccattatcattatacttcatatgtcctaattcggttcccgctttaggcatattctgagatccagatgtaccgctgtcgaatttctccttcatactagaaggtataacaacatcctgcagattcttatttttaccagcgctggaactatattcaattggaccccaattagaatccgtcttggatttaatgtttttctgttgataatcatcggcggattccagaatgtcatctctttcaatgttaaatttttcagccgctctttctgatatatttttattatcaaccttattcttttctgggtgttgaatgtttttattgctatcatgataagaaggttgctggcttacaaaaccacttgtcccgactgctgctttgggttcaggttccatagtttgctgttggattgcatcagaaccagaaacttggtcatttttcaatccagtttgttcgctctcatccatcttcacgttctgtgcaatttctttaattgtatcttgaggaggaccagtcgcagtgttgccagagtactttctacgatctgcagacttcgaacttgtgtccgtgtagacactagggtcgacagcgttcataccggaactaacattactctttgggcctgtacttgtgtaaacactaggatcaacagggttcacatcagtaccagtcatgccccggaaactaccaggtatgacatctcgatctgagttggaatcagtgttcgaataacccttcgtagctgaggagttatctttaacacttgtatgtccatgagtaactgaagggttagttttagtactggaatgatcctgtgcagcagcggtggatttaggaccagtgcttgaaccagagtgaccatggctaacagggtgggtagttttgacgttgatatgtccatgtgtagttgcagtggctgatggaccagtattcgctttagaatgctcatgagtattggtaggagatgtggttttcacactggcatgaccatgtgtgtgagtgacaggggaagtggtagcactggaatgaccatgcgtgtgagtaacaggagaagtggcagctttggaagtgctgtggttatgagtggttgcaatacttggatgccctgcatcacctttggaatgtctatgcgcagtgggggacgcctttatatttgaatgttcatggctagtgggaggtgacgttttcactttggattgctcacttgtagcagcgggtgtcgttgttttgacataagagtatccatgggtagtaatagtagcattagggccagaacttgacttggtgtcggcagaaacagggttcacatcagaagttacgttggcacggcggttagcgtccgcctcagtgtcttcgtgtggagtttccgagtctttattatgcttcttcctccaaggtaacagaatgtttttagccttggtttccaaattcttggacgttgattcgggctgttcttttggtaagttatattcggtcggctttgtagtactgaaagactttttgcgttgagcagaatctgaattggaatcataggaaccgggcttaccaccaaacgaaaaattattttgttcttcttcgccttgaccatctttggaaatggactcgttcatattcatatcttgggttgggtgatattcttgatagctctccactgggaaatcttcacggtgttcggtattattcttatctctacagttacatataaaaaaaggtgtttttgagttagttagtattatatattaattttcttgagggggtggtattattaaagaattaaattcaatattattactattaattacactaaggtgccgggtattattgacgttttttttttcttagtctctttaatgaagaaggaaaaagaactaagttattattagaaggaaaaggaggaggggaggcgagaaagaatggtggagaataaatgaaaatctccaagaaaaaatttcagcacgatacatatggattataccatgtcacaaaaaaatatttcggttggaggtagatgcagagttatggtactgcgaatgtaggaagaaaaaaaaaattaggaagtattttatggtgattatttccttcctagtcgcgtaccgtcactggcccggcaagaccaccatccccagctggttctaactcagctgatggcacctgctttcttgttttcagtttttgaaagaacttgccattgccagccggagtagtggtggttgtaggttgaggctgtccaaccacaggtgcggctgtgatagggcccgcgccgtccgtcgccccactattgtaagtggatttctccatttgagcaccggtgtcaacagaagggctttcatattgggcatacatgtcgtggtccgagtaggtagagtgggccttgtgggtagcactgaatatagtggaccaaatggcgttcacgagcatcaagaagaccgaagtccagatgaacgcaaagtttttgggtcccagccttgcagacctcccgctgttgcggaaggtctttctggccttcacatagcaacctgtgtacaagcatgcagccaatataatgaagaaaaaggccaaccaggacaacacacagtacaggactggcactgccttgaaaggaaggaaggtagccagaaagccgggtaccagcgccagtacgatgaaaaatagggaaatcagcagcatggcccatccaaccctggatagataatagtaggtatcccggttgtttctgaacgacgatggtaaattgacagagttaccaaaattgtctctgggagagaaaggcttggcgggcgccctgctagagcaattagctagctggccgtcttcgtagccgcaccaattgtaattgtaccatctcgtggtcgatggagcgctgttaaagccgtttgtatcagcctgtaaccaataaaaatttttcagcgttccagattctctgcctcctgacagaataagaaaaaacgtcaataagccagcaccgagtaggaataaaaacacaagcaaattaacgaaccttttgaaaatcatagcggtagattatagtgattagtgttacttgttacttggataaaaaggaaagtataagcgttaaacgtaaatacctctttctttttaattcacttcaaaattactgtacttaaagtttgcatctaacggataactaatcaagagaacaaagcaagatcaagtaactgttgcaaagcaaccatccttttatatgtcggcatctgcgccgaatgctcctccccattccagactatccttgttttagcatcaagaaggaaggaagacctttcattgactcttgcttcttaccactcccctctttcccttttccttcgtgtgaaaacgttccactcccttatattcagagcacccttaaatttggttatttggtcttttttttttatattactccgagacgtcactgcaatttggcaccgccgcgttgggctgcgcggatcatgtcttacgaggtgggaacggctccggcgtcatcgtcattatcctcctcctttttcacggtgacgccattttgcgcggcaagaagtcgcagaggattgacggtagcattaattgcgcaatcaagactccctgaatcaggagccgctgcaaccttcggatgggccagctgttgttgcaattcccgaaaggtgcattcaattgggcaccagatctggagtgccacggtagtgtcagggaacagcgtgagcgaggaggttatattgaatttaaatgaatggccgagaaattgtgccaattgcgtatatttttcctcaagaggctgacgctgtaagtaggcgcttgagcggttgaaaaaataagcaaagttcttggaggtaatgatgtgtagttgcaacactcgctccggggccaagccgcgggtttgtaaaagtgggagctcattcgtgatatggaagcagagatcagatgcgtggtactcgatggcgatgatacggccctcgcaactgtataatgtgttgctcttgtgtgtttgctgtgggcgcgggaggcgagccgaggagtccaagagagaagatatatctgtgaactttacatcgaaggaggacacgtctgcattcaggtcgggtatgtgttctgcgagagctggtgtagtgggtgatttttttggttcatgctttacttcatcgaacctcagtttcgcgagatgagaaccgtttctatgtatggggaaaaacctccggtactcttcgaaatagcgtgaaattgcggattcgccaattctcttgaacgctcgttggtagaacaatcttaaatgttcgcactgtgaaggcgaggcgatgctgcttatttgggaatgcgggaccggctcacattcgcgcacaatggcattcaatttgccgttgtacattttcacttttatattcatcttacaaactatgccgtattgcgaaaggttttcatcgcggccgttctgtagatctcttagcccgttgttgaatatttttctgagcttagagtcaaacgtttcgaattggtttttgtacatgatggctttgaagccctcgttcagctctaacttgttctcgtaatctattagatatctgtcgtaaagatagttttggacgatatcgttcttggtaaaatcgctaaagacaaaagatataaaggcaggtttatcaaacgagcaggagactagcatgccaaacattgttatgtatttggtctcaaaagtgtcgagtcccaactgacagaattcgatggtggggtctttccttgccattttgctcatccttgtgcgagacggatcgattgacgccgacgattgcgcaggcacctgcacctgcgcctgcgcctgcgtgtcggtgctaatgttcttcaaactccatactgccatacctgggctggcggtcttgtcattgtcccacaggatcctttcaacttcgacggaaattcgatcaggcttttccagtagtaaaatatccgatatcttgtcgctttgacagtttaaaacaccgaagagctcacagattcgctctctcgtcgggataacgatctcaatgcaattgacgcctggcaccaggaccttgtctgggacatttggtaagagctgcgtaaaatataatttcaatgtgcaatatttgaactcatttatactggcgaattgaggtggattcatgccaacaattttgccctctaacctttcaactgagcctacactagctagggaaagttgctcataactgatggctttgcggattgaggacgcgttcggactgtggaaagaaagctttctcttcctcttgcttccggaatcatcatcgtgccaattatttggtacgcttgttttcctttcaggtgtctgtgactggatgtaggattttgagctgaaatatttcccggtagaggaggtagttgaggaatctgaatcctcaatgggatctgcgctgtcatgcatttcctctcccatgttgcttatatctgtggtcggttcatctacattaagcgtcataagctgcgagttgaattcgttttgggattcaatgtaaggtatccctagtctatttggcacaaagaaaggattaattgctgcggcttttgatttctgcgataataccttttgttggtcttgaacgaacttttttagttctatatcgtagtgaatcaactttacaaatttaaacctgtttttctcgtctctattcatttctattaaattgttgaagatatccacaagtgagttgttcaaatcacattctgaaataagttctgatgacgaatgcttgctgctatttgtcgattttgtagatatggtgcttatcacacttaccaaatccaacggttttatgtcctctaagaatagagtatagttcccgtgttttgatacatataaagctttacaacttgaaaaacataacctttcaaggtgaatatctctcagtattactgttggggatgcgcctgagtcagaatctaaatctggcagttcaatatcaaagtattggcaaagtaaggaaatagtgatccgggctaacctctccgagcccctatctttgaacttcagtttgattaaatattgatcttcttgggattgatctcctcgcctctcaaaattagaaaagcctagcaaacattttgtttcagtcaggtgtattgaggttaaaagcgccacgaattgcacgggaactattgctttgctgggatagccttcaaaatctttactcgagctcacaaaaatacgatttttatgtggaggacactcaggctcttctaaggtatccatttttaggcgatagtttccacggtcattcgtatccaaagagaaacatatatgaatatattcttaaatttccattttgaattagcatttcgcatctcactaggccttcgcgtctcttatgacgttgaaaaatttggatatcaaaggtttaaaaagtataatcacgttaatcaaggctgcatgtacatattaaataatccacatattattcagcagcggatttacaatgaagattgtcttacaaaaagtcagccaagcatctgtagtcgtcgattcaaaagttatttcaaggtatgttaccggttttttcagcttcgttagtgcaccaattttttttactaacacctctatctatgtgacagtattaaacatggttatatgctcctagtaggtatttccattgatgattctatggcggagatagataaattatcgaaaaaggttcttagtttgagaatcttcgaagatgaatccagaaatctatggaagaagaatattaaagaggccaatggtgaaattctatccgtgtctcaattcactttgatggcaaaaaccaagaagggaactaaacccgatttccatttggcccaaaagggtcatatagctaaagaactttatgaagaattcttaaaattactaagaagtgatttgggtgaggaaaaagtaaaggatggtgaattcggcgcaatgatgagttgctctttaactaatgaagggcccgttacaatcattcttgacagtgaccaataagattgaccttatagatatatacgagaagaaaataaaaagcaaacattatttgcaatctttctttcgcaagataaagtaccaaaatctttccatgttatgttctcagtgaagttgagtagagcggagaggagccctccccaaaaaaatgaatacaaaatatctgtgatggatttttgaattcacgcttccttcaataaccttcgccaagaaagtctagaattgttttatattctttacataaaagtaagtaaatcaactttaaaaaactttaagggcgaaaatgaaaaaaaaaaaatgtaaaagtgaaaaaagggacggcgaagcgatgccctgccagtcttactaatccagagggctaaaagcatgtttacagtgtatttccagtcataggagagtattgacctggcatggaaaaagaaacgcacaatgagaaaggggatatatacccttaaattgacgatagttaaggagattttgaggtttgtgttactaataaaccagtaagcatactcgttgatgactttaacgtatatttggtttccaagggatattgaaaccgtatcttaagggatgacgatggttggttaacattccctaaaagacaacgtataaaaaggttcaacaaagcgtccgttaccattatgctttgatgttctcagtacgaaagtttacggttttttttttcaattgaggaacataaaccaaatagatatattatatcaacgttatgaaacgagttactggagttttcttaacacttttgagattttctcaatttgcatcatcggttttggtgatgtcacttttggcgtatgccatccacgcctatggaaatagaggtaataagaaaaccaacttcacattggcaacaggtgtcattagtgtgttttatctgattgccttaggtattttgtgtctggccctacccacattgatctacataggaatgtacttctgtgccgaattgatcgtttgtatgctatggctagcagctttcgttgttcttgccaaagctcaaggtgaacgtagctgtagcaacactaatgcagacggattatactataatccgtacagtggccaatatactgctgacagtcatagaagagcatgtaattcttctcaggcggcaatcgccttttctggcctttgctttgtactgtttttgatcagtgtgatattactgggaattaatgtcttaacacctatcaggaagcgttatcaaacccaaggaatgtggagaagcggcgcttctatgggtacaaagctccataggtggagcggactagctttaagcgagccttttgaagaaacagctgcttacgataacaccaatgttaggaccggtgatgtcgaagcaggtgcaggtgataatgctgcttacacatctgaaccgaatggcgacgcacgctatgcaactaatgaccccaatgggcagtaccatactaccaccaccaacacacgttacaccacaacaacagcggaccctaagacgcgttacaccaccaacgatcgtaatcctggttctgcgaatgtcgctaacagtgcagtggaccagcacgcttactctacggatgagtcaggtgatcggtcttatcaagaaaaggtcacagaaggagctcactctggcgctatgagtggtagcactgcagaaccaaacaggaacgtcaatcaaatgccataaattcaatgatttcctttttgttcgtctatacccttcacatactttttctttttctttttcttttctttgcttaacgatttgaattgctcctgttctaataatggcgtcgtcttttagaaaatccttatcaggtgtgaataatgcttaattttttttatatataatgatttacttttattacttcttatttttatattttcctctgtcaaatatgtgactgaaatcttccaatttattaatattaaagtgtgactatcacttgagtttagcgacagtctctaacgcctcgaattcatcgacatgggaaaattggaaagggtatcgtttttacacttcccattttcttccagcaaaaatgatcggcccagagtctagttaaagcatgattaattctcccagggaatttttttgctttactagtaacagtagttctggaaattattaagcgttcttaaattctgggacggtcgtgcagaatattaagataggtgatatttacaaatataaaacattcatcgttcgtcgaaattggctattcattctttaaaatcgttttgaggtggtctaccatcctcacttttcatatacaaatcaattgcagctgaaaaggcagcaaacccggcaccacccattaaggcagcttgtggtccagctttgtatgccagcccagcaccggtaaaaaaccctgcggttactccgttgtaaatatcatttttagctctaagtgactctatgacacactccaccccagcatatatcataccaatgtagccaaaattcttagcactagagtaggattttttacccatatcggtaaattgaagtttcatttgctgccggaaaggtaaatcagatatttgctgaactgttcttgatattccacccacacctatatttcccgcagttgcagttgctgctgtatttgcaggtgtaggtgtatgaagaggtgtatcatatgccattgacgccatgaacaggcctaaaacaccacccagtgcaaaccctgttacaccactcacaactgattttccaggacaggaagtcatgaagttcatgatcatttcagcaccccgttcaccctgttcttccggagttagttcattataaggtttcttttgagctggacttatctgctccaaaccaaatcctgtgtacaccatcttcgtataaagtatttaaaatcacaatttcttgatcttatttggcagctatctctactatcccgtttagtactatcccgtttagtagtgacagaaaaatagtattttgtcctgaaaagcttcggattttatatgtacgaaatggatccgaggaaatgctgtctgttttattagagaattaagttgactgatgcatcgtctttctcttcagttgtaagctcgatgccattttatcagtaagaccaaaaaccaacacataacggcgtacgaaaatatcaaattgtcacccggtatagatatacttatagagattcaagaaggaataactattaaaagtacgttgcagataaacataagctattgcagcgtcattggagcaacgttaggaattcataatgtaaaggtgtccttgtaaaaacgtaaccgctcatattgttttatctttgacgcaagtattcgattttttgctcttgcataatctgtctccaagacatttctctgtaacatatcattgccctcatcatgacatctttcctgattgctgttcatgcgttttttagaattgtgaaaattgtcggtagacctgctgcttctttccacgcgatttacatgaatgctcggttcgccgtttatgcacagactagtgtcagtactgtcgaactcggtaaggtttctatcttccatatctacgtcactagtattatcacctgaaaacatgcttccaaaggagcttgtttcagtgctatcccccctttgcgtattgaggcagaactgagaccttgttgaacggttttgatagtcaatgttttttttattttcgttgctaacacgttcactggtagtagccaacttaatccttgttctaacatttttggaatccatcaaatagctatactgcttcattgaatcgatcaatctatttaatgatatttgttctgactcatcatcctctattacgcaatgtaagtttaactttgtttcaaatagcgctcggttcaattctgaatcaaatatgattgtttctagttcatagtatgaagtggcactattatcatcacttttactttctattgtcctaaatgcacccattcttaaaattttatcttccagacttttcaagggatcgaccacaattgcgacatatggatcttggaatctctggttcaaatcctgggtttggatatctatattacttaaccaacagtcgtaaccaggatgtgaatggaaccagccaacaacattcagtttagcgcccttgtaatctcgcccatcaccaccgtcattatgattatacatctcgtcgatatattgaaccatatattcgtatgactccaattgtgcatttacgcgagtttctgtccctactacgggaagattgaaacaatccattacaacaatattatcttttaatgtgaaccccattaatatgcccatgatttcaatatttcctccacgaactgcataatgggtgatcttttcacatgataattttgatataagtacgtgggtgtaactcggaatatctgtactactttgttgttttagtttagttttgagcaaggaagattggcttagcgcatgaaattcaggttcttgcgacggcttgaatcgcatacttgatagcgctatagattcagttagttcatcttccacggtgtacctttcctttagtagttgtcgtaattcctttacagtcttatttgaaagtgacatgctgcctcctgcagtttttattgattttcgatcgttgttattcatttttagtttatttgaaaaaccctttaataagagcgcttcctgcgtagcgcgcctttcctaaagtttcagctgaagcatggctccctgaggagaactgcctagtataatggataactcgaaggaaaaaatatcaaatgctttttttagattaaaaataatggacatataaacaactttacttagtacacaataaaacgctgagaagaacatacacatatgtttaattttcttttctgacggcagaactaatttatacaaaacaattttattgaagctcaagcacttgcctccgcttctctttttaacccaccaataaattccaagaattttccaatgttaacatcgataccgttctggtaaacaaaagtgcttgataagtaactcgacagaagaactttcaaatagctctctggaatgttttccaatacggactgaggcccagcaacatcaatcagaatttttggaattattttatccaacaataggtagtttcttaattttagatcattgagccacaactcttgagaagcaactagatcgtcgttcaatttgtttatagtgaaggacaattggtttgaaatttctgaaatgtgggttccatttagttgattcaaattccataactgaccaaactctaattcagcatttttctgaattcttgactgcacttctacaacgtacgacttgtacaacgcagacctctcaccactaacatctccaataaatttgtgcacgaagtcgttatcgttaagcgctagtgaggccaacacttccattgatgaagatgtgacaccacctttgtttgcagaagcatctttgaacagaatacagccatgttcctccaaagcatttttagcaggttgcgttataaatagattggcaccctccacaatatatggaattttacatttcccagtcttttcgtcaacaaaataatgtagattatttagagtaattgagtttggtctaccaccgcatggaacaaaaatgtcgacatgatccacaaatttgaaaatttgagtatgaaaggtgtttctgaaggttgtgccgttagctacaattgtaccatttggtagcatgatatccattgcatccacagaaacaaaaaatccgttgtttgataatttggaagtgtcgaaatcggaaatcattttcctttcatgtgccaagcggcataattcatctttatctaaacctttaggatcacacaggacacctgaaccgtccagaattgccaaataacattcgtttggcgaagataaaagaatttcattggatcccaaatcaccatccggaccaccagtttggaatttgtaaacagtagaatttgtcaagtttaaagtttcgtaaattttattaacataagcacgaacacccagagaagtcataccatattcgtcatggggaataccacccaaagatggggattttccagtcaaaaatgatttccaccatgggcagttcctcacacgagcatggttagttgcccaatccacgaaaccagcagttccttcatctgggccaaaaaataatatttcctcctttggtaaaaggttgacatagttttcctttaatggatcgttgattagaatgtcaatcattgcatccacatattgggaaaaggcgacaaatgtctggtcatgttctaccaatcctgggttcaataagatgacacctttagagccaccctctggaatatccttatttttacgttgctgagtagaggccaattgatagttctcatcaataacgttcttggaattcaaatcataaatatcctgattcctggaacagactatacgaataccgccccttgcgatatctctgaacctgatatggaaccctttgaaagtattaccaacgacaaaaaatataccatagggtgtctctggatattcgaattttgtcatcaccagggaaggatctaatctgaatgatattgctacttttcttgtaataaagaaatttgtcttcaaaatagacttgttgaagatgttcagtgttttcaggatcaacaaatcaggtgaatcatttggaatgaatttattcaagtaagcttcgaactcttggtcattcttaaaaggctccactttttccagtctttgaaaagataatgtcttctccatatctttagtactattatgataatagtgaatttgagcaaaatttttatacaacttggaaattatagtgtaatgcttcgacatgatgttgataatagtttgctgagttaaggtttcatttcttaactttctttttaggttttctacaatctccaaaagagtagtatcattacgcttaatggtgatttgagataaaaggttttgataatcagagcctaaacgattaacaaaatggttaatgaatatagcaccaatatgagcatatatagcttctttgggcgagaattgacgtctctggtaaacctcatggaaagaattgtttgggatagcgtatagcaatgaagcttctctttcaacctgtttcaatgctgcctccacatcgtgaagtagaacatcttccaattgctggttctcgttcaaataaacggaaaagataatgatgtcatcatccttaacattaaacgactctaaatagaacttagaaggtttcaacttgtaatagtggaacaaagagttcaaagcagagtaataacgcttagtggtgaatcgcttgtaagcgactaataacctaatttcatccttattttctacggagcgagtagtcttaatgacaggaccttctctttctttaaccaacttaagtaagagaccgtatagttttttattttcgttcgacgaaactttgtacatggtcttatcactaatcgattcaatatcacctttcagcaaatcctgagaggaaatatctacgccggctggatcatcattagggtaaacactctcataaacaaaagttagctttaattcgctttctggagcccaaaaagaaactaatctgcagtttttttgagacttgttatccaggaaaaggtcatcaatttcggaatctaattcataaggtggacaagaatcatccatttcaatcctattttttttgatggtatccttaccatgctccaaagtatcgtttccgacggcgtcactagcaaatttaaagtttttttgctgagaatcgcttatgctgacaccagtattagattccataaagatggcatgattatcattagttataattttgtttttaatgctgaatagccttggctgaattccgttgaatttggacttcgcaaagaaatctagctttgaagcatacaaagaatgtatgatattcgagattaattggggagattctctcgagaagaacaaatcgtcaatacccaatgagttataaaaccaatctacttcttgttcgatcaaatcgtcgggaataaacccttgctgatctagcaaatctatcacttcctctctctgcaggtccttaccgggaaaatcaaacacgtgatagtccgacatggatgatattgataaagaagcaatatctggtgtgttcagtgagtttaaagcaccgcgatttttgttatcaaaaagcattctttattctttttattgttgtgaatttaatatccttgttttgtatgttttgttgagatcgtgacaatcacaaaaaggattataccaaaaggtaatgtattttttagaaaccggttgttcttatataacaagaattctgactaaacagcagcaatgagtaaacgcttgtcagtgttgatgtcgacagtataacttttgttattgttattgatgccgccgttgactcgtagttacttgtcctactcaactattaatgtgtatttttaccccaattgctccttgttgtggcacgccgtcaggcagtattaaattcggtcctgcggaatcgccgcacacatagccgccagatgggtaacccttttcaagcggacttggttttccgacggtaaataaataaataaatgacagattagattagatatagtcgtattttcacgtatatgtacctatggttacagtgctgtaagtattacttgcgtaagtaaaagctggagcatatggccagtatgacattgctattcttccagttacgttcgctgatgcaggccgccaatgtgggcgtatcgttgatcgatgtttgtatgtatgtgattacctttgtttattattcgaagcgatgcctcatttgggcttgccgcgcccacaacttgacacgtttctatttctttgatccagccatcttgtaatattccgtttatggtaattcttctgaaaggtgaaacttccagtatacgcctcattattttgtgagtttcttctggtagtctgtgcagaatgaaattgggacccatatcaatgactccttcttcgtagccatcattatcataattattgctgtcatcggtagcaggccgtgtcacaagatctttaaaagatgacacacctcttccggaacaaaatgccttgaattgaacatctttcactttgggatatttccaaggaaatcttctcgttatcatacaaaagaatattatccccacggaccaaacgtcaagtgctcttggatcgtactcattgaaataaaagacttcgggtgacaagtaggggtcgctaccaacaattccatttgcttcaatcatctgtgaagacaatggatagtggaagacactggaagcgccaaaatcaatcaatttcaagattccccttcgtgttacaacgcagttgtctagcttcaaatcacgatgagagagaccgatgtcgtgcaaatattttacgccgttgatcagctgtttaaaaagacagcatatttcctcgtaatgcatcttttcactcataaccaaagaaaataaatcatattcgcaatactcgagaatttggaaaattttacctttctcatacagtatttccaatgtttcacaaatatttgggttcttcaatgtggaggcaatacaatattcagaaattatgttcttgatgtattttctctcagattccctttttttctttgacctgtattcctttaatgcaaaaactttattatccaggaccctttggaccagtttcactttaccaccagaaccttcgccgagaacaacgtcgagatctctatatttcctggaaaccaagtcagtggatgcttcaatattactatataaagcctgaataatctgatctctatcgctgtcttcattctcgatcatgagagagaatgatccagttgagactggcgaagaagttgtttccttcaatgatgatgatatagcgcaatcatctgcaactgtgctttcctggtgatcgcatgagttactgttgttattgctaaaagacgttattttgaagagccttttgatacttgacaatgacgtagtataggagtgttttcttatatgggccgtgctttcagtgtcctcgatatgtcttgtatttacttgcactgcttctgaatacgtgtcgtcgagaggattcgtggacagtgaagagaccgaatcttctagagaatatacacgagtagtgaacatcctctcttcctcataaacattatattcatgttctgtggaggtgcatgcaatctcatcacatgtcgccgtggctgtcgtgactggaatattgtgaccgatagtattagaagaattgttgttatgcttgttatcactgatatcattcgctagattttttttggtactactgctgtttttctttgatgtaaagaaaattaatttgccataacttttgggtaaacttaacgagtttgagaaagatgacgtaaaatcggtagaatttttcctcaatcttcctttaggaacaataaatcttgcttcaaccttactgaccatgggagaggaaataatattagagtcgattttagatatgttttcgggcatcttcgtgtcaattttctccatccaggaagtggtcagcttttgcacgtccgtgttttcatcatcccgggaagatgcagtaaagtctgtccgaggtacactatctgcaacagggagagaagaaaaaacggaatcatatgatttatttagcgcctcacccgtcttagcagccatattcacaccaacactagtgggatcgcctaacgagacggaatatgcccaattatcggaataggcgtgttctgcagtcaaggaagctgtagttttgttatttctctgattatatcgcaggattctagacaacgacatcactccgtatgataagtaaaaggattacgtacgctattgtgaacgtttttgcaatctatctagtttttcctattaacttttttcttttcaaaaattcataaaggcaaggaaatatgttccgattgacaataagttcagtgagtgaatgaatgttaatgaaaagaattcaatttccagattttcgtatttattttttttttttgcacctttccttattgtgtgaccacagccgaaggtgacgaagggatggagactagccaaagagagccggctgttagacaaaaaaaaaagcggagattgtttaacggatacgtcttaataagcaatccggcagcaccgagaatgtttttaccctctgtcctttttcttggcgttcctataattcaaataacccccaatatgctaacagccgtaaccttaaatgttagacatgttacccctgtacgtcattgcggggggagtgcattgattaaggggtagtagtaaaaattcccaccggacttgaagtgcggaaaagtagctccgatttggggaaaaaaaagtaccagccgtctcgtctttcatgataaagtgaaatagagcagcggtaataatgcggcgctattgcttccggaagagtttacgtattgggcatctttgccatttctttttttggcagtagcatgattctgcacgattatttatgtttttccctttattttctttttgtctaagatacatggcgtataaaattaaatttgtactcatttaagtagtttggctctatcaggatgaattcctgcaggaacaggcttgttgtctgttccagaggtttgagctgcagtggcggtagttttggcgattttcttttggttgccgtcgttaatcatctttgtcaacctctctttacgttcttcatccaacttgatgtttttgtttttcaatttttctagacgctcttgactgttaccacctccgccaacagttagctcgacattgatcttcttctctttcagtaaggtcccatgttgtaataaggcaatgtccatacgtctttgaatgccggtgcgatctttgtcagcatcgaattccaaaaatgcaatacctttgtcagctctgaggcggatctggtcgggtgaactatttttaaaatggttttgcaattcaacagcagtgatgtctctaggtaagctaccgacaaagacaataaatctgttgccctttttaccatttttgcccttaccaccacggcctctacgtgtttttctttttttcttcacgggttcttcaccatcatttccggctgcactgttgggtctttttccttctggtgcttgctctttttttacgtctttctcttgatctttttcctccttactttttctaaactgctgagctttgagctgcttcttggtcaactttttatcttcctcggaccccattttagctgtagacgtcttcaatctctatcctgtcctctacattagattactttctcattttctcagaaaaccttttaagctcatcgattaagaagaaaaaaatcttagaaaattttcaggaatgccgggtaaacgtatggggaaaggacttggtgaatcgagttaatgtggagttcgtaataatagtactctcataccaagttttccatccataattgtttttggttgccgttactttacaccatcacctttcgccaatgtaattggtggctctttccctctccatctttttttataatgtactaaaattaatacacgataacaattttttcgggttgtgtaaaaactctgaaaaatataaaaagttgatgaaaggacagatttaagtattttggaagacagccgtaaattcattggactacagagcataaaatcccgtgatacgataaaactctaacgatgttctcatattcagatttctgttctatcggtacggccatgatcttatcggccacaacgttcctaatgggtgttttcttcagtaacatgccatacgattatcatcttttatttaatcctaactctactcaagagcatttcgatttggcactgagacattaccaaattttacatgagactccattgccggtgattgttactttgtgcgttgttgccggtattggcttagttggtggtacaattaaggttttcaagccaaaccctgaactgcagatgtttgagtattgttcattggggttgtacgtgttggctatctgtgtgtttctcactaatgtgaaaacaggtatcgactgttctgtgagccataattggggagaagttacggaaaatcagggtttggcagttattgcttcctccaacataattttattagttatgtttgccggtgttatcatcctacaaattggtttgtggtacagtaactgggatttgcaaaaaagattaaaggagttttatgctcaagaagaaagagaagctgccaatgccggtaaaaagactgagaaagttgacaatgcgaaaaagaatgataacaaatctaaaggtgctcaaaagaggaagaacgccaaaaaataggccataatatttttaacattttctctttttgtccctcttttcccgtctgtgacgaaacagacgattatacgaatctagttgtatagtaagatcaatatttattatataaatactgttgaataaataaaactctatctgcttcgtgcataaatttacaaataattccaaagaaatagcaacaagtaccagccttgtttagaagtacgaaaatcttggaatccacttttttctatttttaaataatttctctcaaaaagctattggtttgctgaatatttggccgagtaatagtagacgcactggaacttgtttcttcaatggatgactccgcagattcattgtatgacgatacgtatgaaaatctcccggattcgtgatccgccatcccataataaggatgtgctatatatataccgtctgaggaactagctctgtgtaaatctctaccattttcaaaggaatctcgtttgccctcgccgttggttgttactttataattaaggacatttaggaacggatttgacggtgcttctgtttctgttacctcatcacaacttaccctcttgccaatatcatggctaaagccctttttgctgtgatttttcacgtttcgtctgtttctaataattatgaatccgataaaaattactattacaactccaatgacaactccaaccgtagaaccgacaataactccggtccttctattattggcatctgaggtatcttgagtgtttagtgcaccagatagatattgataaagtttagcatccccggtaatggtattggatggaatggtgaaagttaacggaggatttgattcttgaagcacagttgtttggggaaagtgggtgttaaatgttgtcgatcgctctgtaaatttgtattcttggtcatagatgatataaactgagttctcgctggtgaatacggagtatatttccgatgtagaggttgaggtaaatgttgtagataatggtgttgttagtttagtcgtcgaaggctctatggttggcacctgtgaagtagtgaaagtcttcaatgtacttaacagtcctctatcgatagtgatattgctttgaacagaggaagtgcaattgctaaccagatattgtggacttgaagtgttgttgcggaaggaagtcgtaccatatgcggttgatatggggacctgaatcgaactttctaaaccctcaatgaggttcgtcgtaattgaggatacaacctcagtggataatgcaaaaatgtggtctgtagctgatgataagctggcggtttctgacgtgtcaatttcactcagacttctggattgaggtgtgcttatgtattgcgaagacgttacatttagtagcatggcgaagtatcgcaatagaaagaattatcaagatgcctcgcgccttttgaggatgtaaaaataaatcttaacgttctatgaattactttattatctcgagcagaaccatctgaattttgtttacgtttaatctatgagaaatttctctgacgcgaaatctttcacgtatttttagagcgcccgcccaaggtaacatacaatacggttgatatctcctagtttgatgcggttagtgaaattaatataatgaactaatatactcttttttttgtaaaatatgtacttgagctgctgcattcttcttccatcgtccagtgatatcggtaaaccggtagctttttcttaactttgaacaaagaagagataactacggacccttctccacgtttcgatctttggcttcacttcctcatagcctgtatttgaatctagcaggtgtaatattgtggaagaatgaaaacagtatttttaatggattactaaggcatatttaatgcgttgtcaaggaggatgcttgcactgcaaaaacgatacataagttagcatgggaatttcattaatgaaagaataaatgcaccgaaacaaaatcatgaattaattgtggtttcagaataatgaaaaatccattggctgttcctgttcctatgtgaatggttcatctctgccataataattactattttgtttaaagagtctttactagatattgccgttcaccttttgcctacgagctagcgatagagatttctgtatggtatctgacttgacataatgtccgacatcccgttgaagatatcaaacaatacatgacaaaggtcgggcattaatctgctcaaacattaattctttaaacctatctcgatcatatctaagaaagaaaaaaaactggcttttcggttcctagtgttaactccagtacctggtgttgagaaaaatttactatgtggcccggctaagtagtgcaatattctggtaccatacttctagaaatttttgcgcgataacctagtgttttctgacgaagattttggtgtcatttgtatcttcgtcggtacaaaatggtaatcatagtatgtttccatgtttttggacaaaaaaaagaagaaggtagccaaagagctgaatttgctattcttttgtgattattgtgcgcaaaatagtgacattttctttctcaaattagttacaccccggatcctaacctttactggcctgttgacgttatttgttacgggctcagcccatctgagtaaatttggcaattgtgttcaagtcaacgcctggaatcattcccagcgttttattatggactgggactcttgcaactgttctactggcacagtggatttatagtgaactggatttttcaaaaatggcttcactttgagaaacactatttactatgtttgttaacttcttaacagtgtgtattacttttttgccatattgatattaaaaaagtcatttcgactgctgacagagaatacaactagtaactggagagatagctggtgcagtgagtgattccacataatgccagacttctactcgtcagccagttcgattgttgaggaaacatagcaaagcagttaagctgttttatttgttggcgaaatcgaacttgtgaaagttgtgggctatcctcgctttgattacatgagtagaacccaaggatttatggaaaatttgactggcttcaagatttttaaggcagttctatgagatcacacacttaatccgcttccagaatttattttctttttttgatgatttatgctcaaggaatttacctgttctcaagaatatgtttttaattcgaagctttgcgtatatgatgtttatcaataacgtgtgcatcgtcgatatctcttcgctaacaaaaagcaatttaagtaccaaacaaacagtagtaatagagtgggtctactttgtcgattgccgtagcaggacatttaacgcaaacgcttcggtaatctggtgaaatgattggattaggtgttttgtaaattttttttttttttagaagatattaatgctgcataggggagagataaacgtcgcgggaatttgtggcggtggagcccaggtacgtattaattttgaatggcgcaaatctactaagtacggtatcattttgatgtcggaatacggatagtcagtccataactgcaccaccaatatttttcttgccgttctcatttcctgcacagtttctttgattatgtttgcagaagaatttctttatcgtttagtctaaacaaagaattcgttgtaaagaatttgagagcggatcttgcattttttatttatcatgcttatgttttttctttgatgtaagaagaagcaagtaagatatgtgaatatcttatcactaattcaaataactaagagagctcacaacgacaatttgtgacagcatgcgaagcaaagagcagtgataccagtatctttcatccagtaataacatacgactgatgttatagttaaatgttacattttgagagacttcaacctctcgaaaccaagaggttggttttaactctggtgacttcaagaagggtgggtaccttttacaaagcttgagacgaagcaatagtcagtctctgtataacaaggagaccacctcattttccagtaactcttgaggcatgtcggatggtttgccttgaataaaccgcagtcattataatgaatggcctgtactttcaaaacagtctggaaacagaaatccattgctgaggtaccttttagtagcactttcgttagtgaaggtttaaggttagttcttatttactgcacaagagtttacatttaaccactctaatagtaactgttagagtggtttaactgttaggtgatctgttcattccatttttcgtgttgtatctcaagatgagatagcttagcgttgctacatacataaatctaaacatataaacacctgtgtaactcgttaacgtctgggcttccatgcttctaccatttagaatgatgtagaccatttattccaagaggataagcaccctctgtgattcaaaatgataataagtgttgacgacaagttactctcgcagaattgttgtcaacagtcttgtattagttgttatccaacgctcccgttttcaagttcacttagcgcaagtggtttagtggtaaaatccaacgttgccatcgttgggcccccggttcgattccgggcttgcgcaagtttaattttttttctttttccacattgttttccactttgcactcatttccagtgtttattgtgaatgacaatttcttcaatcattgaaatgattgattttttgggatctatttttctctttagtggttactgatcaggcaactctatatcattgtttaaccgcggcttgcgtatcttattttctttttcctaggcatcttactaaggtactcttatcgctaatcgcttatcgcttatcgtgcgccaaaaaccgccggcggcaatttcgagatgttttatgtcatgttggattttgcaatctattaccatggaggtgagggccttcgatggtccaataccggtgcacgtacccatgtacgtttatcgaataaggggagaacctactaattttaagtcggataacgcggcttggcacagtaatcagttccttctttgggttagaatcttgatgtgagattgtgctcagtgataatgatagcgaatacggcttactcttgaataacaaatgcatatatattaagaagtagttcaaacgtattctgttgactggcatggtcctttccttcttgttgtgattatataaaacagtataagctgtttacttcagttgtgaagtgtaacaaggtcttataatttattattactaacaatgagtatgtcaagcaaaaacgagaataagatatcagtagaacaaagaatatccactgatatcggtcaggcttaccagttacaaggccttgggtctaacctaaggtcgattcgctccaagactggtgccggtgaagtgaactatatcgatgctgctaaatctgtaaatgataaccaactgcttgcagagatcggttataaacaagaattaaaaagacaattttcaacattacaagttttcggtattgcgttctccattatgggtctattgccctccattgcatctgtgatgggtggtgggctcggtggtggtccagcaacattagtgtggggttggttcgttgctgcgtttttcattttactggtgggtattaccatggctgaacatgcaagttccattcctaccgctggtggtttgtactactggacgtattactatgctccagaaggttataaagagattatttcttttattattggttgctcaaactccctagcgttggcagccggtgtgtgttccattgattacggtttggctgaggaaattgctgctgctgtcacattaaccaaagatggaaattttgaagtaacgagtgggaaactttacggtatatttgctggagcagtggtggttatgtgtatttgtacatgtgttgcttctggggccattgctcgtctgcagacgctaagtatatttgccaatcttttcattattgttttattgttcattgcgctaccgattggtaccaagcatagaatgggaggtttcaatgatggtgactttatatttgggaaatatgaaaacttaagtgactggaataatggttggcaattttgtcttgctggtttcatgcctgctgtctggactattggttcctttgattcatgtgtccatcaatctgaagaagccaaagatgccaagaaatcagtccccattggtataatctcatctattgctgtttgttggattttaggttggttgattattatttgtttaatggcctgtatcaaccctgatattgacagcgttttggactccaagtacggctttgctttggctcaaataatttatgattcgttaggaaaaaaatgggccattgcatttatgtcattgatcgcattctgtcaatttctaatgggtgcttccattaccacagctgtttctagacaagtttgggcattttcccgtgataacggtttgcccctatcaaagtatattaaaagagtggattctaaatactcggtcccttttttcgctattttggctgcctgtgtaggttccttgattttaggattgttatgtttgattgatgatgccgccactgatgcattatttagtctggctgttgcaggaaacaatttggcatggagtacccctacagttttccgtttaacatcaggtagagatttatttagacctggtccattttatttgggtaaaatctggtctccaattgttgcttggacaggtgttgctttccaattgttcattattattttggttatgttcccctctcaacaacatggtattactaaatccacaatgaattatgcatgcgttattggtcccggtatctggatccttgcaggtatctactacaaagtttacaagaagaaatactaccacggtccagcaaccaatttgtcggatgatgattatactgaagccgttggtgctgatgttatcgacacaattatgtccaaacaggaaccataaatgttcaaacctttataaagattttatattcagagtttataaggtctagcttatatagtcagtatttttaatttaattatattatagtttatcctatctcaccgttttagcttgttttctgcgcccaaacataaaaatcaagaagcgcggataatttatgatcagctcagcgggaatgttaatggcagatacttagaatttggtggaaacgattttcttctctaatcctcatcagaggagaggtaatcgagcaagggaccaccaagcttaccaacagatggctttgatgaaatattttctctactgatattttttttcactttcttcaatttttctataaaatcatcactctccattccattatctaatggcaatagtcttttcttgacattatcaacacttgcttctggaaatgtcctgtctaacctttcattattcttattattaacctcagtgccagcactattggtattgttattgattagatgcaccatcatgtttaaagactctaacttcagttcttcttgcagtcttttctgtgcagcggggtctggatcttcatttgcccatttcaccaatagtccagtaccctcccttctatcatcccattctttatcgctgggtagcagcaatgtctgattgctcatggcttctttggcaaattctgcattagcttgatatttaaacttcacaaatccacagtttttgctctcaacgtatcgtattctatcaatatcacccaatcgagaaaatacaaatcgaattctgctttctatctgagctggcttcaaatgcttgctattcaatgctccatcaataccacctacatacaatgtcttgtttttcttcctaaatgaaccgatcccgcccatatcctctctatagtcagcaaatttttctctaccaaaacagtccaatacctctgtcctcagggccagtttacctatatcttcttcgtctggtatatgatgcagatattcacatttagggccaaggcaacacataccctttgcaaaaaatagacagaagaacaactggccatcattatcgcccctagtcttcccagaatgaagttgcggctgcaaagcaaatggactaacaaatcgtgtattccccgcaaacccttgggaccatttattataccatatattaaacgtcaatccagtctgcgccggtatagaggagggcagttctgactccttcacttgcactttcgcggatttatccctccaagatgtcatccaaatttctatcaatgcgtatactgtcttactaacgtcgttactaccttaaggcccatcgccagtagtctttattatgatccagccttcaatacataatggaaaatttcatcattacccgcatatgtacgtatgtaacgatggaatgctcaaaaactgaaaaaaatttttctgaaaaaaagtgatgaggaataaagaaaagtaaaaaacgaatgcatgatatagtagtagtaaatggtcaatggatcattgggtagcagagaaacggaaacaagtgcagtaaaaatgggtaaagacaacaaggaacataaggaaagcaaagaaagcaaaaccgtagacaactatgaggccagaatgcctgctgtgttgccattcgctaaaccattggcctctaagaaactaaacaagaaggtcttgaagaccgtgaagaaggcttccaaggccaagaatgttaaaagaggtgtcaaggaagttgtcaaggccttaagaaagggtgaaaaaggtttagtcgtcatcgccggtgacatttctccagctgatgttatttcccacatcccagtcttatgtgaagatcactctgtcccatacatcttcataccttcaaagcaagacttaggtgccgctggcgctacaaaaagacctacctcagttgtctttatcgtcccaggtagcaataagaaaaaagatggaaaaaataaagaagaagaatacaaggaatctttcaacgaagttgtcaaagaagttcaagctttatgaaaaaagttcgcttcttaaccatattagaaatctagaagaaataaaaaaaatctggcattagatatatattttgactgtaggccttctgtatattatataatactactaataacatcaaatgtttgtgacttttcgggtaaccgggcttcgttctactgttccactttttgtatgtttaatgaaaatatcatcaaagaaataggtatataattgataacaagagaatcgcgggccgttgctacaggatattctgcagagtcgaagaatgagatttgtgttcgatgaggttttcaattcagatactgattctccagaatttgaggaaacatgttctacaacatcttctacgtcatcgcaatgccctacacctgagccgagcccagcaataaagttaccttcattcacgaaagttggcacgaagaaattggtaaatgagtcggtagttattttagatcctgctctagaaaacgccttgcgcgatttgaaccttcaatcgaaactgatccccattaatgagcccattgtagccgcgtcatcgataatagtaccgcattcaaccaatatgccactaccgagagcatcgcattcgtcattgctagataatgctaagaactcaaatgcgacagcacccttactcgaggcaatagaagaatcttttcaaaggaaaatgcaaaacttggtgcttgccaatcagaaagaaattcaatctattagagaaaataaacgtcgtgttgaagagcaacgtaagcgaaaagaggaggaagagcgcaaacgtaaggaagctgaggaaaaggccaagcgggagcaggaattattacgtcaaaagaaggatgaagaagaacgtaaacgcaaagaagctgaagcaaagctagcgcagcagaaacaagaagaagaaaggaagaaaatagaagaacagaatgaaaaggaaagacaattgaaaaaagaacatgaagccaaattattgcagcagaaggataaattgggtaaagcagttacaaactttgataaaatctccaaaatgttttggcattataaagacaaaattgctcaaataaagcaagacatagttctgcctataaaaaaagctgatgtgaatgtaaggaatttgctctcacgtcataaaaggaaaattaacccgaaattcggacaattaactaatagcaaccagcaactttttaaaatacagaatgaactaactcaattgataaatgatactaaaggcgactctctagcatatcattggattttaaactttattgccaaagccgtagtacatcaggcggaaacagaagtcagggtaaaaccagagtctgctctgcccctagggaaattgactttatatttgttagtccaattcccagagttacaggaattgtttatggcaagacttgtcaagaaatgcccctttgtgataggattcacgtgtgagattgacacagaaaaaggccgtcaaaacatgggatggaaaagaaacaacgagaataaatgggaagataacacatcctacgatgagagaatgggcgggatcttatcattatttgccataataacgagattacagttacctcaagaatttatcaccaccacgagtcatcctttccccatcgcattatcgtggcatattttggctagaatatgtaatacgccactaaatttaataacaaatacccattttgtcatactcggttcgtggtgggatgccgctgccgtacagtttcttcaggcgtatgggaaccaagcctctaaattgctaatcttgattggtgaggaattgacctccagaatggctgaaaagaaatatgtgggtgctgcgagattaagaattttattagaggcctggcaaaataataatatggagtcctttccggaaatgtctccttagaaaattctgaacttatatatgcacattatgctaatacactttataatgactttattttaaacgtcgccatttttagttttattttcggctcgatatcaagggatggcagaaaatacgtcatgaatattaagccgtaagtgggaaaagttaagacaatctcccactcaaatatacgtacgtgaaattgacatttgaactaccgctcataatatcttattcgatcaagcagaatattcattctttttccggcgcctatctccttacctttatttgtaaatgctactcttcatttatcaaattttttaaagcagatgcataaacctttaagatggctaataacgatagccttctacgtttcgaacgttatattaataggctattccctttctagtaatggctcaatatctgaattttatctgcattctgttgtacttattgaatgcttctctttactaggagtggttacctctgactgcttaacaccatctttgtcatacatttccagtaacatattccatatttccgatagagtatccggcatgactttattagcattggggaatgcacttcctgatattactagtacttaccagtcgatgaaatctggcgtgacttccttggccattggtgagttatttggtggcatattttttctgttaaccgttgtgattggactaatgggctgcgtagccactattcaatttcaacatgacaagtctattgaaacttacacagaagaaagctttgaccaaaatttatcgtatgatagaagcaattatatattggatgtcggaatattcacttttatgctcttagtttcgggcacttttctagcagatggaagactgtacttttgggagtgtattgtcatggttttaacctactgctgttgtgctgtctatttaataaaaagctacaaatatccctgcgaaatcaatgatgctttagaaagagaggtagaaataaaaaaaactgtacttgcaaataatcatatcactgttccaaatcgatttacattaacgactaccagtgacattacatccacagacgatggaataagatatgtaaggcctttgggggatacacagattgatgaggacaacgctattagtttagatccaactcgtttaccaagtaaatccctggataacatttcgagatttaatcaaggtatacctgaaagaagggatttaataagacgtagaatacggggatatttacggtcgcattatcatggctgggtaagaatgacgttacaagatcttttgaatatatgggagaagcagaatctttttaacaatacagtaaaatcgttgtctttaccctccgatgatactcatttatttactaaagcttctttagatgaagaagggaggcctttaataagaaaaaggatgaattcattacaacctaaggatttttacaaatatttgtccctacggaatggggaaaattcaaatgcgctggatactgcaatctctgctccccaaaacgagtatcaaacttactataatgaacccacaagtttgtttttgactgtgccacaaaaaaaaacctccaagaaatcattaagctgcgatcgcattccaaacttggtccggagtaataatattatattaaatgacgaggctacacgtacacaggaatctaccaatgccttgaacagcatatcagatgttatcgacaactctctcttacagtatgagagagatgatataattctcgatagaacactatctctctgttcaacaaagagtagaaccgcttggcatagtttccaactttacaattacttaacagatgtgtccttggaaattggtttctttgagttcttgtcattattagtcactacgccggtatcaataattctttatctttcaataccatcagagataagtcaaacagaccatgacttacccctttcatacctacagaatattcaattgattgcttcgccaataattctcaaccaactcatcacaaataacttttcattttggttgctcatcttatcgctggtgatagccatcttattatattttaaaactaggaccataccgaacaagttcaactctgatataatctttacagtagcatttttattgtcattggcctgtctttcgaaagctgtccacataattgtagtcacgttaacgcattggataaatgtgtttaatatatcggaaacaatactaggtttaaccatttttacatggggtaattcgattggtgatttagtgtcaaatattacattcgtcaaaataggtgttttagaaatcgcgataggagcttgttttggcagtccacttttatatttcttatttggcgtcggatttgatggaattatgataatgctaggcgacaaaactggaaaaatagtgagtggcagagatagtaatattttaatgcatcatattgattttaaagtggataaaaacttaatcaatactggagtcggaattctgatcgcgtttttgatatttacggttttgataccattaaacgactggaaaattgacaagaagattagtattgcacttcttacgttgtatatagttgtcacatgtattagtgtttttttagaagttcaccaagtgtaatttaataaatcaagatttcattttttatatacaagctataataaatatattaacaacgaagcttgtatgaatagtataaaataaacaaaggtaggaattacatattctaattgacaaaatatttatgcagtggtcatttgaaaatggtcattaaattaaacaagtaatatgagaggaatgagagggaaataaataactgaaagataaaggagataaggaaaaaaaaaaaaaaaaaaaaaaaaaagggaactttagttagtaataatagagtttttggactgatcaaattaatggtgttcatttgattctgtctaaattaatttcatccagaattttctttgcgccatcggcaatcattctttcagctagtatcttaccacacgccatggaatcttctttaacattttctattagcatttcaatttcgtcttctactgcttctgtgccttcaacgtcaactacaatggcctttaatagtaattttttagtctcttcattgtatttagattccacaccaataggaacggaacaacccccctctaaagttctcatcaaagcacgctccgaaaggcaacatatagttgcatttagatcgcaaatttcgtcaagaatcttcatcatcttggtgtcaccctttctaatttctatacccagggcgccttgtccaactgcatggtacattgtatccgaatggaatcgctgcgtaattctgttttccaaccccatacgcatcaacccagcagacgccaagatgatgcattggtacggagattttgggtcgtctagtttttgtaatctagtttgtatatttcctctgacactttcaaatttcaaatgtgggtattttctttttagctgagcagatcttctcacggatgaggttcccacaatccccccgtctggaaggtcatccagagacttataagcagagtaaaagggcatgacaagacaatctgttggatcgacccgcttagtgataccccccagctcgaaaccctctggtagtaaagtgggcatgtccttcagagaatgaacgatcaagtcaagcttctttgagggatcgtcatggtaaagatggtcttccaactcctttgtccataaagctttaccgccaaatgagtacaaaggtttgaattgaatctggtcaccaagagtttgcaaagtgaaaaccttgcagtcgtagtccggatacttttcttcgatcagttttaaaacatggttggattgtattaccgccaatttcgattttctcccaccaatatgtagagtttcagggcccatagtacgtgtgtatttaccaactacaaatttatctagattttcttcgcttttctttttttctattgttctagatattaatacgggatgagaagaacagaatattcaaaatctaatacagccctgtaccatgcaaacacgagcgtcaatctgccaatgaccttgaattcaggctatgtgtagcaataatacagatagttagtagcctcgtttatataaagcgttcctttactttttcattttctttctttttttatgtttgatttttttactttttcactttaaaaaattgctgaaattttcgtagccaaaaaaaagaccttcattgcttactcatcggtttcttattggtcagacgctccccagggtcaattgacaaggagagaaggaatgttatatgggaattgctgcgtaaagatggtcaaaaatcctggactgccgtacgaacgacaatgtaaggatgactgcattagccagaaagacatctttacccccggtgctgccagggagcaaaataattacgaaaagtggacgcaaagttaacttaaactacaagggtagcagcagaatgtgtcggtggtaccggtgtgataatgccccatttgagatgcttgtaattgtggcctagcaataagaacgcaaggcgtttttgttgaaaggagaacaaggttagacggtgacgtttaggcgcataggcaatctccccttattgttcacccttatttccaccctcaaacgataaagcttgctactttgatgaaaaaaatatataaaagggattgaaaagcagatcaattatgtagcaatagtagtaataacttgttcaattgcttgtctcaacttgccacaaactatcatcaacatgaataggaatacgactaccaataagaacgcgaatttgaataacagtagaaatgctaacgctcccggtgaagcaggtcatcagaacaagacgggattgatatactggactaaccctagcaagtcgggtgcgagctttgctgcgactctggtgagtttgctgatcctcagaaatgtcaatgttatttctgttttacttaagatcggatacatggtgttgttcacgagttttgcggtggagctttctacaaaggtgctatttgataaaggagtagtgtctaggtttggcatgcaagagtctccggaccttgttggcgtcttaaagcctcatatcgaccgcgaattggatcgtctgcctgcgttagaggacagaatcagaaagttagtgtttgcacacagaacaagaaacaattttaccattggtgtttccctctatttcttgcacggcctatttgctatattctctatgaacactgttttgataatgaccaccatctttttgtacactgtgcctttaatctacgatagaaagcaggctagaattgaccgtgctatcgacaggatgaaggatctagttattcataggtttcacaaaaattacaacaaggtggttgaaaagactgaaccatacattgacaagattatcccaccccaaaccgatgaaggcagctactcaacctctatcagtaacgaaaacaaatcttctacttctcaacgtaacaagagcggcctttcctcttctgagtttgacaacatgaacgacacgtcagcctccaaaagtggcaaagacagctattctacctctcaatataaccgagccgaatatccagtttctcagaatgagaatattggcaccttaaaatctgggaagcaggaaataccaacagagaaggatttcaacaacaggcatgaaaacttcagtaaaccagatgtcaagacatatgatccaagaacagttgatattgaagaagaattagcagctcatcagcgtgaactggagcaaaacctaaaagatggtgattacaatctggtaggaagcaaggaaatcccagatccaatcaccgttccagctccaactagacacaccactaaacccgccgaaagccaatcgattcccatcaagaataatgaaaccttacacaaaaccacgcacggcctaaagcaaaaattgcaacacgcataatctagtttttttttttttctctcttctttctagctagtagttcatttccttttctttttttcaaagaggtcatatttatcaccaactatatatttttttgaagaaaagatatcattacaacgataagtagttacaatattttttttatttagtttaaaataatgagtaaatgacgtcgcatttcttcgcttttgttatttttattctcctctcatttttgaggagaatgttacaatattttactaatgtcctgaataatatttgatttatggcataataaagaaatgcgaattcgttaatttgtcaaacttcgaagagcatcaactgccttcctgaatcccattcttgcagccctctgataatattgtttggccagatccaaatcaacttcacaaccgacacctttttcgtaataaaatcctaaggcaaattcagtgcgggctaatttaccgtctgaacacttgctgctcttcaaggcccagttgaatgcctctttattgtttggtttcaaaatatttggtgctcccgttaagtaccatccacttaaggataacattgccatcggattccccttcggctgagcagcagcagctttggaataccaatatatggattttttggccaccactggcaaccctaggtctccaaactcataacaatttcctaatttccattgcgctaaagggtactcaaaatctttggcacattgttggtagtattttattgccagttgagagtcttttcgtatgccgttcgcaaataataggttctggatttctggcggcaaaacactgaattcatatattttacctaactcatataatgtttgtggagagtcacccttttgggcagctttatcaaaccatttaatagctagcaatacatcagtcttttgcatgttcagaccgtataaatggctcatccctaatttatacatacacgcagaatttgaacaaacttctgcgccatgctggtagtattggaaggccttttttatgcattgttctttggttggtgatggatccaaagaagaggtgcccctttggtattcaaagcatacacctgcacggtagcatgcatctgaattgttcaatttcgcagctttacaataatattccagcgccttttcatcatttttaataacgatgtttttgttctttataggtaaatagggttggtgtgaatacagcgtccccattaaatacatggcaggtggccattttaaagttatcaattttgtgagcaccttgaatgaatgttccaaaatgactttctggtttttgagcatttcctcaggctttaagcttcttttgagcttctccgcgtttatgttatattgcgatatgaaatcctcattaaaggcatatgtaagtaatgtttcacaccattgcatttgtatctcgggggtgaattttgaagagtcagtaattgtcttcttgtacacttgatagaaagccaatgcctctggtgaataggaagacagtttgtcctcaccacctgaggacccattatcgtctgtcttcgcgctcccagtgggtggttggttgattttttgtggtggaacaggattattattcaaaggtcgtattggagctttttcctcggttctgtaaactttttcctgcagtatcctagattcagattcctcatagggtggtggcgctgagttgtcccttacagactctgatattcgatttccactgcttattgatgcatcttgtacagctggtgaacccaaactctcttttgtagaactaaaattgaaaggaagttcatacctactaccagtactgttggtgccattattggcatatcctatttcacctgttggcttggaattaaaaatgtccatgccgttattactatttatggttactggagtgcctaattgaccaccatcagcattcccgtctgtgaaattcagcgcactcaaaggcagcgataatgatgaggaagatgaaggggatgtaaaaggaatagctggtgtgagttcaacgatagagtcatccactggatagggtgcaggcactatattttgagctggcaaaccatgcctatccgaattggcatttcccaatttatgcgaggactcccgcgcccttgctggtggaaacatgttaatgtgtttgtcatagaggttaggttgcggttggccctgattaaccattgcctactgtattaaaacaaagtattaaaacgtggtggtacactctgtacaaaagaatagaaggaaatgaaaagaaaacggagttaaaatctacttcataaaaagagacgcttccaaatccagtctctaccacgttcttgtatataatttgagcaactcaaattaaattaccgggatatctgcttattctacaagccatagcatccagtgctaaggttcatctcaagccatcttcaatacacttgataattagtcgtcaattttaaaattaggtttcgttcttgaaggcacttaacctaagctttttactatatgacctattaaacaagtctttttcatagtgtaacctaacgtttatacactaataaccctagggcttagtagagattcatacagaaaaaaacgtagagttatagcagtaaactgagaaaagaaagaaggttagtacaattgaagagtaaggaaaacaaaagctttagaccttattggaagtgcttgggcgcggagtgtgattataaataatgttgcagctaaggtttatgcctggatgggtccccagaaatggtttttttggtttgaaggagacaattggtacagtacataagagattttatgctctggcttctgaacaaccctcaagaaagacagtaaagccgctggactcgaggaagacgtttctcatcgatacatacaagcatttaatggagaacagttctatgattttttttgtccattacaataatctttccaaaacagaagatcaccatttcagattcaagattaaacagacaggagggaaactcacaaaagtaagaaacaacctgttcgaagtctacttgagaaattcgcatctgcccgacccatgtggattcgtgaagcgtaaagagcaaaactggaaacatccactcttgccactactgaagggtcctacggccacaattacatacgaagacaccaaccctcaacaagtagccaagctattgaaggttctgcagtcagcacaagacaagctgatggtgattggtgcaaaagtagaaaacgaagttttgaatgtggaaaaaataaacacttttaagactctccccacaaagccggaaatgcagtcgcagttagtcagcgttttgcaaatgctaagtgggttgggtttggttcgtacgttggaaaacagttcaaatgcattgtatttaacactaaaatctcacaatgacaaccaaaaacctaaagaggatgtggagtcaactacagatgcagaatcgaagggatcaaagtaaaaagaaaatgcccgtaattcgacaagttttataaaggttttactattcaatcatgtacatacatcatcaaaaaataaaaagacaatgaagcaataacggtaaatatactttagtctatgtattgacgtcaaaattacctttcttttacctttcttacctttttacatatctcagcgaccgttgaaaaaaaaaaaaaatgaaaaattttggtgatgacttcagcaaaaaatttcaggatatttctgacatttcactttattaaagcgccacaaaagctggattagtatagattcagcagttcccataggataaaattttcaagcgtttattgttaagatgaaagccaagccactaagccaagatccaggctccaagcgttacgcataccgtataaataaggaagaaaatcgtaaggagttgaagcatgtaaagatcaatgaaagttctttggtgcaagaaggccaaaagatcgacttgccaaagaagagatattatcgtcaaagggcgcattccaacccattttcagatcaccagttagagtacccagtatctccccaggatatggattggtccaaattgtacccttactacaaaaacgcggaaaatggacaaatgacaaagaaggtgacgattgctgatattggctgtggattcggtgggttgatgatagatttatcaccagccttccctgaagatcttatcttagggatggaaattcgtgtgcaggttacaaattacgtggaggatagaattattgccttaaggaacaatacagcttcaaaacatggatttcaaaacattaatgtcttgagaggtaacgctatgaaattcttgcccaacttttttgaaaagggccagctttctaaaatgtttttttgtttccccgatcctcatttcaaacaaagaaagcataaggcaagaattatcactaacaccttgctgagtgagtacgcatatgttttgaaagagggcggtgtcgtgtacacaattacagacgtcaaagacctgcatgagtggatggtaaaacatttagaagagcatcctttatttgaacggttgagcaaagaatgggaagaaaacgatgaatgtgtgaaaataatgagaaatgccacagaagaaggtaaaaaagtggaaagaaagaagggtgacaagttcgtcgcttgtttcacaagattaccaacgccagccatattgtaacatagatgtataactagaacaatttaccacatatacataactatttcttatgtttattttcctaaaatcctttatccaactacaatctactaaggcttaagctattttccttttcattatttaataactgttctttcagtttacagctccatttatatccggttaattttctattgctaccaacgattctatggcaaggtactaacaatgccaggttatttgagccgcaagctcttccgacagatcttgcggcagttggcttccctattctctttgcaatatcaccatatgttacgacgtggccgtgttccacgtttaaaagctcattccaaactttacgttgaaaatctgttccaaacaggaactcaaagggaatagcgcccgatggtaatggcattttgttttctaaacatattgtataattttcgattgatttcttatatgtttctgcctcttttagttcctgtaaatcgtacattgtatcctgtttctcatgtttcttcaagaagccttccacctttcccaataaaaaaagcttatcattacctaacgaggcaaaaacaaggttttgagtcttttccctaaacaccaaaaatgcaccagtcacttcagtttcaatgaatgtatagtaaagcagttccttcatcgttggtccatttagatcaaaaatgcgaccgttttcaattttttttttgtgcatatgctatatcattacttgattaatcttccttgtttccaccgcattttaaatgccctgccaggccaatagcgccgtgccttttttctaatgactataataagaatatgtatgtaggataaaactaaacatttatacttaggatgaagcaaatatttttatgaggccatactaggcaactgccatgtctccaggcgaattctggcctccacctgaactgggtttattcgcagcaatgttgtcgctgatatttggatcggttctgttatgaaaactgaaaaattctccagtccttgatggtcctgaatcagatgtaatgaaataaacattttgtgcagaaccgtgtgtctggttcgataagtttccgtttttgggtagaatctgctcattttgaatagatgaataggcttgattattttgtttgatactacttcctagagtgtttatctgatacgcggaaaaagatggtgaggaggagaattcagaaccggtatcgtcaaaaacatcatcatggttaccgctaccgtttccggtagaatcatcatcagaatctaacctttcgtcacgggtttctataggaaaaatcttcagcacaaatataatggaaataaaggaagataaagatggaataagataaaacttccaagacagacggtcaataagtataggggttattaagctgacgaaccacttaaaaatccaataaaagtttgagactagtagtatcactggggcctgtgacaagtgaggtagaagctcaatggtcataacccatcctatagaatcccaactgatgaagtgcgtaaaaagaaaaacagcaaatagtattgatatatacctcgttgtgctcttgggaaaccagtctgtaaaagatatggtaaatagcaatgcacacatcacaatcgaacctaagagtacattcgttttctctttacgtttccgtaacaccaagggaacatatgctaatattacgatgctgtaaattaaagcattaagccccgttaaatagatagattttctttctcctctccccatttgttgtaatattaacggtgagtaatacaagaaagcatccactccatttgttcgtgtgagaagttggaaacctatcaacaattttattattgaagaaaaatcctttaagatatacgcatatggataggagtttttttgaaggtgtgactttaataatatgtctcgtttcaggaccctaaatttcaactgagtttggttttcttcgaaatttccatcatcgaaaacattcgatattaaaaccaatgcctctacgtcgttcttttgcttcaacagccacgaaggggactctaaaataagatagaacgacattaggtttagtattattccaagtgccacatgtgttgacaaagggtatctccatgcaaagcccaaatatctgaaagcacaattaatccatattccgaatgaatacgcaatgacactagagacgcattgaatggaaattaatgtccgttttcttatacagggaaggggaaactcgaattgataaattattaccatagaaaaggcaaagcccatacctactccgagtaagaatctacccagtagtaaacaccattggtttagagccaagacctgaacaatggcacccaaagagtatatcattgtgcttatttggagcatttttttcctgctacaaggctccaggatgccagaatagacaaataacgacgccatgaacgcacccagattaacaatgctcactatattgcccagcggagaagtaagtgggtaatgaaaatacttctggaacgacaaagtcataacgttaccagatatgaggccttggtccaaccctgacagcgaggaaactagcaccacaaaagatataaacgaagtacgcaaaactcgactggaatgcctttttttcttacttcgtagttgtgagatttcagcctgttgtagtaattggcggtatggatcatccattgataatctaggggtatgttcagaaagcggcaaaaccacagtagcatcgctgtctctatatagagaaccacgacgcgagctatgagctgtgatgttgttctcaaatctgaatatgtcggggttcttgtggggcagtgaagttagtgcggtatcatcctgtttactgttaaaatcctgtgctagctgatgtgccctatcaatatgcgccgaactattagcttcctgagtaagtggtttatttgaacgtgacatgtttaacggaggtttcattttcttgaaaaagctgagatagtaacaggttcctctgtagtattaaatttagcgctcttctttatgttcattctttttgtcctgaagtggcccagaagcccttcaaagcaatcctttatttttttagaactacgcggctgacgtccttacctcggtacggtgatacagctattacattggaaaaagtagttagtcaaaaaacaggaaataatacataaagtacaaactcatattgttatacattttatattcacaagctgaatgccaaggaaaatagacaagaagttcatgtacttcatttgctcaacaggttatcgaatctaggtatcaaagattgagctaacgcaaatgagaaaaccagttttggacccgttgttagtaatttaggtgttaagcccttgaaaaacgcagttacaccttcatttttcagagtgtttttgacgattctcaacccgctttcaggattatcaaaattcctattttgaattcttgtcttgatgacatctaatggagcagaaacgatcagagaggagcaagcaccgacgatggaggagatgaagttttgggaccaagtagcttgagaataatctttcaaacccaagatatactccttggcgaatgcattaccaccaaaaagggcgaatgaaccgggagcatttctggcagccgtccacccccaacccctatataagttgaacaggccttcgtctctcaaaatcttgatgaaacctctacctttaaacgattcgggattggtctgtctcttaatcttcaacacgtccagcggcaaaagaacaatttcaccaataccaatcaaagatccagcagcggcggatctcattgccttaccagtcttttcaccgaaaagattatcaaaatcctttttgtagtgcttattcaaaaactcgttagcaaaaggctgaccaccatatttatacactctttgaagaactttgtatgatgcagcgtaaccgagacccgggaacaaggtaaacaaacgtttgcccaaaggttcgctgaaatgatcacgaaaaataacacgattcaattcctggccagaggttattttggtgtggttggacatcagtcttttggaaatggtgtccacaggatggaagacggcaatttccattatgcctgcagaggcggaccccaaaagacgagctaatcctgattgtttcttatcggtatgaggcatatttcccttttctaatactttggaagatgctttgtttgatatatgtctaaaggctaaatattaaccatcaaaagagatacacgatttatatagtcacctctatatatctatgtcgtcgctttgtagaaaatgtgacagcaaatgcacagtgactcacgagtttttgttttctcgagctttatcaagaattgcgatcgttctttaattttcattttctttttttttcgggcagtggcggcggtgctacatgccattggtctacaaggaaactgtggcagcgaagattaacggtggtatgtttgcgatagagcttcctttgcagataggcggatgccgtagtgatctctaccgcttcgtatttatatttatttatgtagtcctgaacaatgctttgaatccgccaagctttgtgccacaggaggagttgatgtgtctagtgtgactggttcatttgccaccaattttggccgatcgtctttctttgcagtctcttgagatttgtcttttgaaggaagttgaggactgtccgtgggcacccttggcagagttttcagagtcaaagacttcaggttggctatatgtggtggttgtagtcttgataagtaggatttccttgatgagtaatcaaggtttagtgttgtgctcttttcggaatatgactgcccgtctggagccgctaatagaagccgttgaggggtgttgtcaatttcttgatggttcgaatgctgggataagagtagaagaggcgcatatgtacttgccacagcgggggcgagtggacacgatttttcgctaccaagtttttggaatatgcccaaatggtgtttgcgctgggctggtggtagccgttgaattaatgattgcacgtaactctgcagtagcttgatggtattattttttctttctaaatgcaagtgggtagttcggctcctctcatcggccattttcttatgcaaccttagatcttgcaattcctgttcctggatagcgaacaaatcctctggattgttttcctcaaaggggtccaccaaagtcacattggtggggatttgtacttgattttgtgtttctgtttctatttgcccctttgtttctgattgttgcgatagttctgcttgtaatgcttcgatagtctccctctggttagcgatgcttttcttgtaggataacatcgtgagattggctttgtcgaccagctcaggaatacatttaagatagtcatcctttgctttagcctgcttcttcaagtgctccagtgatttggttgcttgtagcagttgcattttcaagttattcactttgatttcggaattttttctcacgttattcagttctcgcctcactttggccagctcttttgagctttctgcatcaaacaccttgctgtctaaacttagttctagtccttcgtagtatttttcatggaacgtgtgaatctcatctaacttggtgttcaccgtgttctggacgtttttgtagtcctgtaacttggcgcagatttccttcttgagattaacaagcaaagtgtattcatcgtagttgcgttcttctttgctagagggaagtcgaacaagttcgattctcttttcagcagagctcttgtgcgtttcctttaacgcgttgttctcatccaggatacttttcatttttccatgtaaactagccatcttaatttcatagcctatgatctcgccggacaataacttggcgctagacactaaagcggcttcattttctcggtaatgattcactaaagattgaagctccttgactttgcttttcatctgccttaaagatgacttcttttgtactcttgagctgctgaggcccttcgtcacagccgcatattccttgtccgagttgaaagatgagctcgactcctgatcactaccatctatcacactgcgagtgatggcatccaagacaccacgattttttggcataagcactcagtcttggcctttttccctcctttctccactgatcgaagctgtgtgcaaaaatcgtccccggtgtttatttatttgtcctatggatagatatgttactcacgcgtcgcgtcgctcctaaagacatgaaaagcgcttttacatctttgctaatactagcatcgcagaagatcttctccattgctatgcaacatacctgccttggtagttggtttcataatttacaatatacaaagttatatgccctccgagtcaaggaaaagattgtcttccaaaaaaggtgcaactgtgcgtttagaattggtggagaattatgtgatatgcttcttcaccgtcctctgcttctgcctaataccacactcatcaattgactggagatctggcctatcttgctactacttcatagatttttttttttttcatctatccccttccatccccttctggttctaccccttcagcgtgaaaaatcaccatacacgatcaatccgcccgagaacgaaaagtgaaaagaacaaacaagtcgtgtcagatccattcctctattcctgtagtcgggttgcattctgaatttacacgtcacgaaccagcactatttcgctactgtaggtgtagaacattaggacaaggcaagcttctgcgatagacactttactcacacatatttccctttgttcccgtttgctctccctaattgaacaataaagatggtcaaacttgctgagttttctcgaacagccacgtttgcgtggtcacatgataaaattccattattggtctctggtaccgtatctggtacggtggatgctaatttctccactgattcatctctagaattgtggtcattgttggctgctgattcggagaagcctattgcttccttgcaagtggattccaaattcaatgatttggattggtctcataataacaagattattgctggtgctctggataacggtagtttggaattgtactccaccaatgaagcaaacaacgctatcaactccatggccagatttagcaaccattcttcctctgtgaagacggtaaagtttaacgcaaagcaagacaacgttcttgcttcgggtggtaacaacggtgaaatttttatttgggacatgaataaatgcactgaatcgccctccaattatactccattgacaccgggtcaatcgatgtcgtccgttgacgaggtcatttccctagcatggaaccaatctttggcccatgtttttgcatctgccgggtcgtctaatttcgcatctatttgggatttgaaggctaagaaggaagtcattcatctaagttacacttcacctaattcaggtatcaagcaacagctgtccgttgttgaatggcacccaaaaaactccacaagagtggcaacggctactggtagcgataatgatccatctatcctgatctgggatttaagaaacgccaacacaccattgcagactttaaatcaaggccatcaaaagggtattttgtcattagattggtgtcatcaggacgaacatctattattgtccagtggtagagataataccgttcttctatggaaccctgagtcagccgaacaactgtcccaattcccagctcgtggaaactggtgttttaagaccaaatttgcaccagaggctccagacctatttgcttgtgcctcctttgataacaaaattgaggtacagactttgcaaaatctcacaaacactttggatgagcaagaaaccgaaactaagcagcaagaatctgaaacagatttttggaataatgtttcccgagaggaatcaaaagagaagccatctgttttccatttacaagccccaacttggtatggggaaccatctcccgcagctcattgggctttcggtggtaaattggttcaaattactccagatggtaaaggtgtatctataacaaacccaaaaatttcaggcttagaatcaaacactactttgagtgaagcgttgaaaactaaggatttcaaaccattaataaatcaaagactggtcaaagttattgatgacgttaatgaagaagattggaatttattggaaaagttatcaatggacggtactgaggagttcttgaaagaggctcttgcattcgacaacgatgaatcagatgcacaagacgatgccaacaatgagaaagaagacgatggggaagaattctttcaacaaattgaaaccaatttccaacccgagggcgatttctccttgtctggtaatatcgaacaaactatttccaagaacttggtttctggcaacattaagagcgctgtgaaaaattctctagagaatgacttactaatggaggccatggtgatcgcattagattcaaataacgaaagattaaaggaaagtgtcaagaatgcctattttgcgaagtatggatctaaatcatcgctctcgaggatactatactccatttctaagagggaagtagatgatttggttgaaaatttggatgtctctcagtggaagtttatctctaaagcaattcaaaacttatatccaaatgatatcgcccagaggaatgaaatgttgattaaattgggagacaggttaaaggaaaatggtcatagacaagattctttgactttgtacttggctgccggatcattagataaggtggcttcaatttggttatcagaatttccagatttggaggataaattgaagaaagataataagacaatttatgaagctcattccgaatgtctaactgagttcattgaaagattcaccgtattttccaacttcattaatggaagctctaccattaataatgagcaattaattgccaaatttttggaatttatcaacttaactacttccacaggaaatttcgaactagccactgaattcttaaatagtttaccaagtgacaatgaagaggttaaaacagaaaaggcacgtgtcttgattgcttccggcaaatcattaccggcacaaaatcctgcgacagcgacgaccagcaaagccaagtatacaaacgccaagacaaataagaacgttcctgtactaccaactcctggaatgccttctactacttctattcctagtatgcaggcaccattttatggtatgacaccaggcgcctctgcaaatgctctacctccaaagccgtacgttccagcaaccaccactagtgctcctgttcatacagaaggtaaatatgcgccaccaagccaaccttcgatggcgtcaccttttgttaacaaaacaaatagctcgaccagattgaattcttttgctcctccgcctaacccatatgccactgcaacagttcctgcaacgaacgtatctacaacgtcgattccgcaaaacacttttgctcctatacaacctggtatgcctattatgggcgactataatgctcaatctagctctattccttcacaacctccaattaatgctgtatcgggtcaaacgccacatctcaaccgtaaagccaatgatggttggaatgatttgcctttgaaggtcaaagaaaaaccatctcgtgccaaggctgtatctgttgcccctccaaatatcctatcgacaccaactccattaaatggtatccctgcaaatgctgctagtaccatgcctccgccacctctttccagagctccctcttctgtgtcaatggtatcaccacctcctctacacaaaaattctagagtcccatccttggttgcaacttctgagtcaccaagggcatccatatcaaatccatacgctcctcctcaatcatcacaacaattcccaataggtactatttctacagcaaaccaaacgtcaaacaccgctcaggtagcttcatcgaacccctatgctccaccaccacaacaaagagtagcaaccccattatctggaggcgtgcctccagctccgttgccaaaggcctctaatccatatgctccaactgcaaccactcaacccaacggttcctcctatcctccaaccggtccgtatactaataaccataccatgacctctcctcctcccgtttttaacaaacctcccactggcccccctccgattagcatgaagaagagaagcaacaagttagctagtatagaacaaaacccatctcaaggtgctacttatcctccaaccctttccagctcggcctctccattgcagccttctcaaccgccaactttggcttctcaggttaatacctccgctgagaatgtcagtcatgaaattccagctgatcaacaacccattgtcgacttcttgaaagaagaactggctcgcgtaacaccattgaccccaaaggagtactccaaacaattaaaggattgtgataaacgattaaagattcttttctaccatttggaaaagcaggatttattaacccaaccaacaatcgattgtttacatgacctcgtcgcattaatgaaggaaaagaaatacaaagaagctatggtcatccatgctaatatcgctacaaaccatgctcaagagggtggtaactggctgacaggagtgaagaggttgattggcatagctgaagcgactttgaattaattcagtctcaaaactttcagtacaaaaagtggcgtattggccttgtttttttcttattatgtcttatagtattatatttatatatttatgtacttatccttttatgtttaaacctaatcaagatcacaattagaactagcttaacattacttctcaaaaccaaccaatacctcttatatcttttttacagcctttcccttatgtttttaccatgtacacctcgagcggcaaatctccggggaaattttaaacttgccgcatcgcacattctaaagaacaaaaggaggaggaactgtcaattattctataatctggggaaattcagtcatactgagaaaaactagacaatagtcctatcctcggcaaattgcattgatagtacttacacatcgagagatcataggacagataagaagcattttattgaagaaaaacagagagagtcactataagttgacctcactatagaaattaaaacagaaaagttttactgaggacctttttaaacagaaggatatgcctttgttggcatagaaagaagaatttataaatggatcctaatagtaacagttctagcgaaacattacgccaagagaaacagggtttcctagacaaagctcttcagagggtgaagggcatagcactgcgacgaaacaatagtaacaaagatcatacaacagatgatacgacaggtagcatacgaacccctacgagcttgcagcggcaaaattctgacaggcaatctaatatgacatccgtgtttacggatgacatttctaccatagacgacaactcaattttattttcagagcctcctcagaaacaatctatgatgatgtctatatgcgtaggtgtttttgttgcagttggcggatttttatttggttatgatacaggtctgatcaacagtattacatctatgaactatgtgaagtcacacgtagcacctaatcacgattcatttaccgcccaacaaatgtccattttggtgtcatttttgtcattgggaactttttttggggctttaactgcaccatttatatctgattcgtatggcaggaagcctactatcattttcagtacaattttcatcttctctatcggaaattctttacaggtaggtgctggaggaatcacattattgattgtgggaagggtcatttcaggtatcggtataggcgcaatttcagcggttgttccattataccaagcagaagctacacataaatcattaagaggtgctattatttctacttaccaatgggccattacctggggcttgctcgtgtcaagtgcagtgtcgcaagggacacacgcaagaaacgacgcatcttcgtatcggattcccatagggttgcaatatgtctggtcgtcatttctcgctatcgggatgttctttctccctgagagtccacgctattacgttttgaaagacaagctagatgaagcagctaaatctttatcgtttttaagaggtgtaccagtccatgattctgggttactggaagaactagttgaaataaaggcaacatatgattacgaggcatcttttggttcttcgaacttcattgattgttttatttcaagtaaaagtagaccaaagcaaactctaaggatgtttacgggaattgcccttcaagcatttcaacaattttcaggtatcaactttatattttactacggtgtcaatttcttcaataagacaggagtcagtaatagttatctggtttcatttataacctatgctgttaatgttgtctttaatgttcctggtttgttttttgtggaattttttggtagacgtaaggtgctggttgttgggggtgttatcatgactatagccaactttattgtggccattgttgggtgttccttaaagactgtagcggccgcaaaagttatgatagcatttatatgtctattcatagctgccttttctgctacatggggtggtgttgtttgggttatttcagcagaactgtacccattgggtgtgagatctaaatgtacggctatatgcgctgctgctaactggcttgtaaactttatttgtgctttaattaccccttatattgtagatactgggtcgcatacatcatcattaggtgcaaaaatattcttcatttggggctccttaaatgcgatgggggtgatagttgtttacttgaccgtttatgaaacgaagggtttgacattagaagagattgatgaattatatattaagtcatccactggtgtcgtgtcaccaaaatttaataaagatattagggaacgcgcacttaaattccaatacgatcctttgcaaagattagaagacggaaagaacacttttgttgctaaaagaaataattttgacgatgaaacaccaagaaatgattttcgaaatacgatatcgggcgaaatagatcatagtcccaatcaaaaagaagttcattctatcccagaacgtgttgatattcctactagtacagaaattcttgaaagcccgaacaaaagtagtggtatgacagtccctgtgtcaccttctctgcaagacgttccaatcccgcaaacaacagagcctgctgaaattcgaaccaaatatgtggacctaggaaatgggcttggtcttaatacgtataatagagggcctccctcactctcaagcgactcaagcgaagattacacagaagatgaaataggcgggccctcatctcaaggcgaccaaagtaatagaagtactatgaatgatattaatgattatatggcacgtctcattcacagtacttctactgcaagtaacacgacagataagttctccggtaaccaaagtacccttcgttaccacacggcttcctcacattcggatacaactgaagaggacagcaatttgatggacctgggaaacgggcttgccttgaatgcttataacagaggtccaccttcaattttaatgaattccagtgatgaagaggcaaatggtggtgagacgtctgataatttgaacacagctcaagacttggctggtatgaaggaacgaatggcgcagtttgcgcagagctatattgacaagagaggcggtctggaacctgaaactcaatctaatattttgagcacttctctctccgtgatggctgacactaatgaacataataatgaaatcctccactcaagcgaagaaaacgccactaatcaacctgtaaatgaaaataatgatttgaaataattaatttaatgttattcgatgtattaattaagcggacgtgcattataattttaatcatgtgaaagaaataattgtaacttgagatactactcaacttttatagatacacaatgtttatcttgacacacattcaattacattacttgatttaatgcctttccaaaattatgatcttttcttctataacacttttggatacttagccgccgacggataccatcttcggtcaacgtcggaagtcattataaacgaaaaggtttcccaatagaaaagtcctgcaggagccacgtataacactggcttgaattatcaacaactctcgaaggcgctggaagagaatttttacgcaagttagtattcgcataacattagttggcaaattacacaattttttgatacaatatatatacatatattttccccattgtttttcttagatgcccacgatgatcaaaaaggatgataaagcaatggagccccctaatgaaaaaccgcatagaaagatcgaaagagatgatgttccagaatcttccaatcacatcccacctccagaatctggtgttttaaagggcggtaaagttaattcaaaaaccagagctttaaaggccgttacaagtatcattgcagacgccgatgagaaccctcagaagaaagtgaacaatgagacgaatggagtccaaaagcaaaagacagaagatttgagtaaaagaataggtaaatttgaataccttttttacaagtttttacttgtgttgttatacatctgcttcgggttgtttcggtacggtcaataccaatataataaaatgaaactaagaatattcagtatcatctacaaccatgcatatacaccacagttgattagacaggacgttattcctctgaaaaaaattcctaaaaggttggccgctatcttggaagtcaagccagttggcgacgttggcggcggtgtgacaggtttattaaatgacgcgagtgaaattgtttgctggactgtttcagctggtataaaacatttgatgttgtacgattacgatggaatattacaaagaaatgttccagagctgagaatggaaattcattccaacctggctaaatattttgggccagctcatgttccaaactacgctgttaaaatacctcattctaacaagatattctacaatctagacggaattgaaaccgagactgatgtaggcaatgagatagaagctaaccaagaaaaggacaaaattgctattgaaatttctttattgtctaacagagatggtagagaaacgattgtcgatctgaccaaaactatggctgagttatgtgcggttaacgaattgagcgtttctgacatcacaatggatttagttgattcagaactgaaacaactagttggacccgaaccagatttactgttatacttcgggccttcgttggatttacaagggttcccaccttggcatattagattaaccgaattttattgggaaaaagataacaacgaagtcatatattcggttttcatccgcggcctaagacagtacgcaggatgtaaagtgaatgttggtaaatgatacttaagagctaaacgaaaagataagtatctcgctcaaccttttaattttgcacagttgaattctcgtctgatacttaagaaagtcattgcccacatatataacagtagtaataatgataatgatagcaatagttttaagctagctacttagttgcatttttcaatagtttagtaaaaaaagtcacgcaataagctctcaagaagccactaataccgtaatgatagcagtttattgtagaaaaaccatgttattacccttccctttttatttcttttcgcgttgcaaatcacatataacgaggtggcttgtatttgtcaaaccaaaaaaaaaaatgaaaatcgaaaaatggaaaaacagagagagaaacggaatctttgacacgttctcgatccacttgtttatcgaggtggtttttataagtcttactagatagaaagttcattttgttttgaaactttttggaacctctggcattgaaggtataagaaagaactcaaacaggtttaatagaattaaaaatgggtttgtttgcctctaagttgttcagtaacctttttggtaacaaagaaatgcgtattcttatggttggtcttgatggtgctggtaagaccaccgttttgtacaagttgaaattgggtgaagttatcactaccattccaacaattggtttcaacgttgaaactgtccaatataagaacatttcattcactgtctgggatgtcggtggacaagacagaattagatctctatggagacactactacagaaacactgaaggtgttatctttgttgtcgattctaacgatagatcgcgtattggtgaagctagagaagttatgcaaagaatgttgaacgaagatgaattgagaaacgccgcttggttggtgttcgctaacaagcaagatttgccagaagccatgtctgctgctgaaatcactgaaaaactaggtttacattctattagaaaccgtccatggtttatccaagccacgtgtgctacctccggtgaaggtttgtatgaaggtttggaatggttaagtaacagtttgaaaaactcaacttaaaaattctagaatatggatcaaatacgcttgtataaactaaatgaaacataaagattaagaacttaagaggccaacgtcgatggatttattgacgatcaccagccaacacatatagattttagtgtaaaagcaataaaaaccaagataataaaataaaaaaatactgaagaagcctaactagtataaactactttaactaataatggcaatttgatatagaaacaaagaaacatgatatatttaggatattatacaacgcattttcatttgttttacagcacccctgcgtgaatcatatattgacgtttcgctctcaggtccaccgtgttctcaaaagatacttttaaaacctaaaacacacgaaatcatattatgataattcagaatgatagtgtggtactgtgtcaattgactgttcaagactgaagaggatctttgatttgttgttactcaacaaataatcttcacgaaaactttctcaatctggggactgtattaatctcagacccatacatatctacacccataactttttacatttaattttttatcacataataggtagcttaaattgtaaagtcgcaaaaaaaaatggcagcgcagcctctccgggtgaaccccacgacaacttacctggcactccatgcactaacgggcgggtttgggcaggattccagcatcaattttgcaaaattcacacctgagtaattcatatatgtaatataatgttaagcatacgctgtcgattagcactattattgaccgtagaataggtacagtgagacagtatattcgaaatggtatgtttgagatgaacaaaataataaagactgacaactgcagaacagagaggatcatagcaacctagtgcaagaaagagcctcgaagcgttaaacttttggaacgtaattcatccgttggctatgtctattcaatacagttagaatacgaaagctgtaatcaagtatatcggattattcgcaagcaaagaatcaaggaaaagaaagtgaaaatagcatacatctttaaattcagaggttttgctgaattttaatagggaagtttacgttatgattgttggccgtagatcgcctagcgtttgaccaaatttaattctcctaatttttttattgtaaaaaagccttccaacgaaataaattagttattggttttttttctctgttacgagggatatatgatgcctgtgcttgttagttcattataagtgctaataaaatactaacgttaataaaaatttggaatattatttcattttttatcctattaataggccggtgttaaagcttacgaactaagaaccaaatccaaggaacaattggcttctcaattggttgacttgaaaaaggagttggctgaattgaaggtccaaaagttgtccagaccatctttgccaaagatcaagaccgtcagaaagagtatcgcctgtgtcttgaccgtcatcaacgaacaacaaagagaagctgttagacaattatacaagggtaagaagtaccaaccaaaggacttgagagccaagaagaccagagctttgagaagagctttgaccaaattcgaagcttcccaagttaccgaaaagcaaagaaagaagcaaatcgctttcccacaaagaaagtacgctattaaggcttaattggaagttcaattatatactatcattatctatagttccaacttttctacgtttttctagcaccttttaaataattgttaaattaaaacattttcatcgaaaatcttcaaaatataagacacattgagcgatgaaataagccttatttgattagggtcaattttgcaatttattctatcacttattcattcactcgcttgctttatgttttgcttcttcctttttttgttttttgaaacaaagaatcttttgccttaactcttcattaggtgttacatcctctagttttaaaggcattctattaaacgggtcagtagagtcactaagcagatgtgctttgatcgtgcttctatcaatattcatcttggatgctggtaaaatgacaggatccttcataattgtgtacatcaaaggatctaagaactcgtcaggaacatcaccatactcaagatcttcctcttcatcagcctttctttgctcttcggctttattggcaaagttcaatagtttttcgatgaactctggagatgctaaaccagtttttctaccaagaatatcaactgcgcgaacaaagagatttctattaaatgatctttcatctttagcgacagcactgatgaactctgattgctcggaaagattgatataaacagttgttaaggctttcaacaaatcttttgggttgaatgaataactttgtgggtctttcacttttagttccccgcatttgggaccgacaagtgactctaagttatagtttagcatacttgccagtctatatacgatttctggtgtgacaaatgcagccggtatatccttcgaatagatttcgaacagtttcatcgatttatcggccaatccacacgaggacttagcttgcctggaagcagacgccaatcttgtttgtagttctttgtcctcttcctctcttgttggtggcgcgccccttgcgcgattatccagctcattttggatattatgcacctcagccaaattacttaggccttcatccaacaggaaagtcaagtcattcaacatacgagcatcgaacctcacaaaaaagtcagcattgttttgagactgccagatcaattggtttttataagatggtatcttgtaataaagctcctccaaaattattgatatgctatatctgctgttgaatttatcgtaaaattgtgaagaagagcctgttttttcaacaataacataaaagtctagtagagcatataacagattcttgttaactaattcgtcgtgttcgaatatatccatcatgaatccgggggaattgtctgttagaggcatagcaccaacgcttaataactgcactaatttaccttttaaatgtgggttggaaaccaattcaggacaacggaggaccattgttgtaaactcaacaaacgatcccagacgtggatttctgaagattggagaggtctggtacttcgaaatgtatagagaatagttaactggaccttctacaacaaattctggatagtatttaaaaggcactggagcatgcgctctcaaaaaatcagcgttgtccacgttttcaacacctatttggtccggaattaatggcaatttaatttgtttaaacggaaattcgtgttcaggatccacaacacgaatcaagaacgtagatgcaccacaaataaagtcgaaaacctctagttgaagagatctatgagcgaagaacccttgaagagcaaatcgcaaagattctgttgttttcaacgccttctccatcttggataattgtgctgtaatgaatctggcaaagacatcgtggttcgcagctattttctttactttttcaatttcttcctttaacgctttgatttcagatcccatcttctcttcaaatgataatgtacctcccagaccataatgcaaataggttaatgtcaagaaaaagcaatcagagatgaagtttggcttagaatctgctgtttttctgttcttgtcataaaatgcatctgcctctttaaaatcagaatttaatcgtgtttcccctgataaatcaataaataaacttgggttgttgaagtaatttgcgtcgatcttgtcgattttcttatatgaaatatctagaaatggttgagaaaatctaaccaataacaaagtgatattggacataaatccgttagaggatagttctttgaatggtggatgatcggctctacgtaaatggtttttattagcgatatgggcaaaataactaatcatatcagtccttgagtttaaggagccacgaacaagcttatcgacaataaaaaagagtctatctatgacaactttatgctcagcttgtagagattcatggatcatggctgtctgttgtttggaacgcaaaaggttatcgccgtagttccggattgccacagcagcttctatgggagaaagagataaaataggccccaatatcgttttcctttcaaaatcctgtggtttacagctatagtctgcaaaaaaaccatctattttagtgaatatttctgcaataggtttaaatgtaacaaataactcaaaaatggtaagaacgttattgtaaattacagattcgttcaaatcaaaatggctgacatgtttattacagtattctaataatgtcgggaaaacagcgttaagtaaatccaaagcggtaccttctaatatggctctttgaatgatttgggaaaggaaatcagtatatgagttaacgttagaaacaattccagtgatataattgatgaaagcaccattcatgcaaaagttttctatttgtgaggcaacgacaccatagccaatgacaagacgatcaatctcttggaaagtggaatgtaatgactcagcatttggcttgtttttggtgattcttttttgttgctgattacggcgaaagcaatcgttcaaatattcaaacggtttatccaacttctcattctcggtgagttgatataatagtagcgtatcaataaaatcaactccaagagttgagccttgaggcacttcctcggacttcaatagagagtagccacgggtatcggaaggatcggtggtgatttgtaaaatatcttctatggcggtcatgatctatggaatgagggttctactttcaaagttaacttttccccttaaacaacttgtggtcaactttacctttctattggctgacacaattctcaaagatataattaacgtttactgtggcaacagcaagtggttgagtctaaaaatgtgaataaaatggcaattacttaatgattaacaatgattgcggcgtacacctctattattttgttgccaatggttagaatctacctttgatcttcaattcaccttttgtaataaagacagactatcgcctctgacgaatactgacaaaatagcgtcctcgacgaaaggatgaatcgttaagcgcaaaataatattgatataataagaatatcgattaagaagcgttggctagtgtcatatgcgggttagcctatctgtttcttctttctttcacatacaactcgacaagttttggcgtaggcaattgagccatattgtaccagcaagccgtggtgacagtatgttgaaacgtgcatcttataatgggcgcacgatttattttattttaattaattttttagttatttcgtatcgtactaacaactaagatattcaagtctcttcaagtatataaggagttagggcagaagtaggtgatgacagcactagattctcgaaactggggattgacacccgctatggaaacgggcttgttccagaaaccacaggaccgtatctttataatagagctggaaaattccatagtgtcattcataaactcaaacacagaatcatttcagctaagaccgatgaattcatattataggcttctatcgcaccaaatagctgagtaccacaacttgaaccatgttttggcaagaactcaagatagttgtgtgattcttttcaaaggtgagaatttccaaaagattgaaggaaagccactcttacaagagttgcagctgaacaaaaaaccggaagagtgtgcttcctcaagtgagagtattgaaaaatcgaacaataacagaatatttcgaatcttaaagcggaaagaggtaggtaacgagtgcgattataaaatcgatggcaatacacgtacaccaaatagcaatttgacagccaattcaaataaggaccaaaaaatcgaaatcgatgataaatctagtactgatttggaacaagaaagaattgagaaggaaagactttatgaacaacgtaaacaagaaatttttgataagctcaacaagagtgaagacgatgtaaagtcaaccaacagtagcggtagtagtgatagtgacaatgaatggagtgattggttgaacggagatgactctaacacacaaactagtaacggttcagttagctcttcatcaccattcaattcatctgtgacgacgatacaagtaaacaaacctcaacaacaattttatgatagtcgaagaggaagaggaggaagaagaagaggaacaaacaattacaaagatgcctatagaggccaaagtcgtcggaataaagaaaacggcggttaccaatcgggatattcttcgccatatcttgtgtatcctcctccccaaatgggtggcaatagtctgccaacctaccctctaatgtataaccccgctggtcctgcccccggtcctgcaccttcacccatggtaatgggcaataacacagtcttcatgaacccttacatgtacaatatgaatccccaagggtcctgttcgtttggcaccccaatccctatgtatcccccataccaatatcaatatcaataccaatataacactcagtatcacagcgggccatatagcaatacaccaagctataattctaacaattacacaagatcctcagcaaataagtaccaccattttcaaggaaaaaattcatattctggtgcgattccgaaacgtagtgatgacagtaacagtaataagaatgagggaattcgtagggctagtgttgagggttcgccgtcatctagggatactgattcggtagagatgaaatttgataaattaaacatttagcgtgaggagtgaactatacatagcgaaaaaattacgtaacggtttatagaaattctagtatgagaacagtaatatatgagaaaaagttgttttcactttgtgttcgaaaaaataagtatttgaaaacgaaaaaatagtttgtatgtttgtatataagttgttattatcaaaaattagagggaaaaagtaactaaatatatattaaaaaaaaaaaaaaaataaatgtatgttggaatgaaatagcgtagtaaggataaaggtgtaatagatatatattataagaaataatccggtgtcttcctggtgacggttggttcaccgggtctcacagatggatcgtattgtaagaattgcctattatggttttcatccacctccataatagcggcctggttaccacatctataacaataatttggagcactgaaaatggtgacaacattttgctggtgagaccaagaatatccttccattaccaattggtgagctcttgctattagtgataggtcattagtgtgattgaattgctcactgatgtcttgaccaaaagtgaagcctgcacctctcggactgattccccatccgcctctatcatcaggatcggaccatagaaggtcacacattggaccttcgtgaggcacttcctgtattctatttaaatctctaacttgatctattgtctctatcatgggtgagagacctccatgcaaacagaagattttattatccaccaaggcagtaacggggaaataatcgaatagatcggtaaacattttccacacgttcgcactgccgtactttctcaaacattcgtcataaaacccatatacttgggtaatctgcctagactcgtgattgcccctaagtatagtaattctatgtggatatctgactttcatggcaactaggtaagatacggtctcaacagaataatatcctctatccacgtaatcacccatgaaaaggtaattggtgtcaggacaaggaccaccaatcttgaaaagttctaacaagtcatggaattgaccgtgtacgtcaccacaaatggtaacaggcacgttaattggtttaacattctcctcgaactgcaacacgtccaccgccattttacatagtcgtgctacatcgtcttctgatagtggctcgcatttactcaaatgctcaatccattggtcaagctgatttatatttgtattggtcagttttagtggtttggaggatttatgatctgctatacccgaggaccccggtttaaaattaaaatcttccaactcttcatctgtgtcttcgtcattagaacgcgccttcgtattatttttgccgtcatcactattcatgtcttcgtcgagagtcggtgataattgatcttcatctgaaccatgcatagggtcatcaatttccatatccatttttttcgaatgaaagccagttatacagaagtgccaataatataaaattcaaaaaaagacgtaacaggaacaataaccggaaaggaaagagagcaggtaggacaagaagtaaacgggtttgcgtgttcttgttcgaacactgttttgcagcgggctggtaccttaagaagtttgctctagttacagcccttcaattggttttataaaatggggatgtccctttgaaactttccacgactcttttccacaattcagcggaaaagaaaataataacctcttctagattacccggtcatgtcagggtaatacacgattgtatttcaaagtgcacaacgactattgttgtcgtataagcttttggattaatcttagcattaattgatacataattccgcaagaagaagttttaggagaatagagtttcgcttcttttattaatattctgtcctgtgtcacaaaatattgtaataatttggtgcggtgtatgggttcaagttcccaaaaaaacaactaatttgcgacacttcgtagttctgtgcttttatatggaatatacttgtggactctattcctggatgtagatttgcttacagatagccaagaaatattagaaaaatatgcagtgtaacacaagtatagaagatggtttagatgggggcgacataactttcccatcctacagccctgaagcggaggctcaaaacagattcttaccaagaagtgagttcccctctgtgaggcaactcgtgatttcgaaacaaaaaagcagaagaagaagagaagaaaatgtatttgtgggaaaaatggaggacgtacttgtaaaatggaggccacctgcatcttcacatcgtggcgcaattgaagctattaatggcacgcatccatatcagcttagcacagcacaattcaactcgagaagatcggatccatttggttcaacaaagagagatgaatccgtgcgttccattgtagaatcgtttaccgattggtggaaacgcaattccaaaatgttttttcgtgacgaggaagaaggtgtacgaaccgaacacagtgcgagtcaagatgaccaagagttgcagcttttcgaagaagatctcttctcatttcacctaagcccaaatgatatgtcaaccaggaacagcgaacatcaagtgcaaacaccggtgcttttcccgtacgaagctcctactcgaacaaaacaaaacccagcagaaagaaaagtcattgaaattggggacggcgaagaactctctatctatcgagatgtttattccaatcctattcctgtcagctacctagataccttaaacttgaaccactccatgtctgtacggcaaacacaacagcaacaacaacagcggcaacagcagcagtatgtagactcttcatcggcatttcaatgctgtacagactccaattgggcgagaatatttttttgccaccacgattagactccactttgcttctatagtcctatctattgttctttttattcctagcataaccttattgtattgttctttttctttttcctttttcttttttttttttttttttttttttttttcacatctttttccacggccgctcaaaggggtctcacactggattaaaagctgaaaacaagaaatggctctttcgataaggttgcaacattttgattactacgttgattagaataaaaagtaccaaacacatttctcaaagcatatagatatctaagattataacgcaggagtcgttctttcattcttagagttaaaaagcaaatagagaagaaaagaaacaatggctggtgcaattgaaaacgctcgtaaggaaataaaaagaatctcattagaagaccatgctgaatctgaatatggtgccatctattctgtctctggtccggtcgtcattgctgaaaatatgattggttgtgccatgtacgaattggtcaaggtcggtcacgataacctggtgggtgaagtcattagaattgacggtgacaaggccaccatccaagtttacgaagaaactgcaggccttacggtcggtgaccctgttttgagaacaggtaagcctctgtcggtagaattgggtcctggtctgatggaaaccatttacgatggtattcaaagacctttgaaagccattaaggaagaatcgcaatcgatttatatcccaagaggtattgacactccagctttggataggactatcaagtggcaatttactccgggaaagtttcaagtcggcgatcatatttccggtggtgatatttacggttccgtttttgagaattcgctaatttcaagccataagattcttttgccaccaagatcaagaggtacaatcacttggattgctccagctggtgagtacactttggatgagaagattttggaagttgaatttgatggcaagaagtctgatttcactctttaccatacttggcctgttcgtgttccaagaccagttactgaaaagttatctgctgactatcctttgttaacaggtcaaagagttttggatgctttgtttccttgtgttcaaggtggtacgacatgtattccaggtgcttttggttgtggtaagaccgttatctctcaatctttgtccaagtactccaattctgacgccattatctatgtcgggtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattgcggagaaagaggtaatgaaatggcagaagtcttgatggaattcccagagttatatactgaaatgagcggtactaaagaaccaattatgaagcgtactactttggtcgctaatacatctaacatgccggttgcagccagagaagcttctatttacactggtatcactcttgcagaatacttcagagatcaaggtaaaaatgtttctatgattgcagactcttcttcaagatgggctgaagctttgagagaaatttctggtcgtttgggtgagatgcctgctgatcaaggtttcccagcttatttgggtgctaagttggcctccttttacgaaagagccggtaaagctgttgctttaggttccccagatcgtactggttccgtttccatcgttgctgccgtttcgccagccggtggtgatttctcagatcctgttactactgctacattgggtatcactcaagtcttttggggtttagacaagaaattggctcaaagaaagcatttcccatctatcaacacatctgtttcttactccaaatacactaatgtcttgaacaagttttatgattccaattaccctgaatttcctgttttaagagatcgtatgaaggaaattctatcaaacgctgaagaattagaacaagttgttcaattagttggtaaatcggccttgtctgatagtgataagattactttggatgttgccactttaatcaaggaagatttcttgcaacaaaatggttactccacttatgatgctttctgtccaatttggaagacatttgatatgatgagagccttcatctcgtatcatgacgaagctcaaaaagctgttgctaatggtgccaactggtcaaaactagctgactctactggtgacgttaagcatgccgtttcttcatctaaattttttgaaccaagcaggggtgaaaaggaagtccatggcgaattcgaaaaattgttgagcactatgcaagaaagatttgctgaatctaccgattaagatatatgtagcatttatcttctggtatatttgttagatgtcttttcttcgtatttcaaaaaatttatataggcgtatgttaataagataaaaaataattaaaggaaattaacagatgtacctcaatgaaatgacacagtaacataatacaagacttgccaagcacaattacaatgataaataacttttgttttcaaaaaaacggacaattgattaaactatgtgagacatatataaagcactatataaatagtaggcaatggtttacaccccaccgtgagattagtatgcaatttagatccattatgaggtagaatagaaactaacatgttaattcatcaatgacattacgatactcttgaaagaatttaaaacaaaattagagttatttactcataatccgcttatttggatctggctctcaccttccgtctctttctcttaagtcttctagttctcttctttctccacttggctctcatttcgattgaatcgatgtggtctggttcttttagtacaaaatggaacggatataagataaatgagagttgcttagaagtccagttttatagaagacgaggtcagtttcgtcttgttaaaatatcgtccatctgccatggggtaaagtgaaactttcgggtagggtaatgaggccagccttgcctgggaaaaagttaggggtcagttacttttaagagttcattgatcgagagcgcgtggaaaaaattctagaaagaaagctataaaatgtgcggatgtttgtatatgtcaaaggtgtacgggagcgcatcagaaaagtacagtctaattttcgaacgctcaggaatacctgttatgtatatttacatgagatagtggacaatctacattaaattttgtttttctcttgagatttcgattcttgaaggatgactttgttcaagtcgctttctagttcatgaacctctaagaaatctaagatcaacggaagggttttcttgttaagtagtaattctggtgcaccttttgattccttttgattgccctgcgtacggctgctggtcccacgtttatatacttccgtatatcccaacagttccctgaattctaaattttgttttgaactttccagtagactcttcaagtgcttagcaccaaggtaagctttgatattaacataagctctataagataggtagaaccctggaacatttggtataagcggtattaaaattagaggaattgtcagcgggagacctaaaaggcaatataaagtccattttttgtgataaattaagccttcttggtagagctttttcatttgtctcaagcactcatcagggctagaaattccagggggataatacacgtgtaagggttgagtatcgacctgttctgcctttacggtataatctttcaatgtgagtcgaatctcttgggtcttatctttctctcccttaattctcttcaatatatagctttcacttggtatggttaacagactattttctgaccagggtgtgctatttaacagagactgcaccatggacactatttttttattatacgatttaggggactttttcagttttctccaaagctttgctgatttctcaacgatccacttttctgcttttaatattctagactgactattaaagagattatcggtatgcttatagtaaatgaatgattctttgtccgttattggtatcacagtcactttaacaggatcatgcagatatttttggagtgaagccttttcaagttttgttgaatacgccctcattccgtagaacagtcgagaagtggcagttatactagttggcggtataaatattgaacgtatcatctttaatctaaaatacaccggatgaagttttggtattgtgataaaatgattctatcgatgaagagcaatgatatggatactgctacgttgaaaaggaaaaatttcatggctaactagtaactgaaactgtgccagatagcacaccctttagatactatcttggcacaatgcccgatgcttactccccggcggagacagccgtcaagtccatccatccaaaagtggaggaaaaacaagaaaataaagctatcgaacaaggagcgttgaagtaagaaaaacaaacgaagaactgaataaacacagcctgcttcaaattatggaaggagctgttacacatggtaattttcttattttttttgatagatggtggaaagtggtagcgtggaagttgcggattatcacgacgttttatgggctctaaatcggtataagctcaacaaatggttgagggccgaattaacgaaaaattattagaccataattgctaccagctgaaagattatctcattataatacgcttgaaaccctctaaaatgtcattcgtagttaagtacacttttttgatctctccaaggttagccgcccatataaaaaactctaggaaccaaatttggtatactgcgtgcgcttgagattcagtttttgtgtaaatcggttgctgcaaactatttatattaatgttacatcgatgcaagattttagccatgttcctagtttcttgtctatgagcgtttactcaaccgagactcttgtttgctattatctcgattcgacgaacaaacagttccctgggtattcgaacaaagcacagttggtgattttgtttgaaactacagacgtgctctcttttacaaaataaattgtaggaagtgatccgcacaggcagagggaattacagatcacgctcctctcttatgactaatgcactcagcattttctcttccttataaactccgtccacagtacccgatcagctggctcatcgttattctaaattaactgatgactgatgttacgtctgcgtcaaattccgccggaatattgcgtagttttagtaagaaaaaaacaaattccgacgggaactctctgcaaggaagtttaagcgtgggttactttgctaggttgagaaaaagaattctttagaggatcacacgtagtaaaagaaaaaaaagatctcttcgcgccactcccggtttctctgtggatacggcgttactagcgttgcaagtggcaaaaaaatgagtaatgtcacaatggcctggccttgtcccactatcccttattcatggttgaaaaatatgaccaaaattgctggggaattttctcttcggtagtggacgacgacgacattagagcaataggcaataatttaatttgcgctttaggttcttgctgacgatgatgcgtgagtaatattattaccaagttttaagggcctcatcgctggccattttttacacctgcttaaatacccgatgatgatatatataaatgatattggctgcttatcgataaagtgtatttgatatgttcccgtttagtttattcttgtttcttatctacataacaaacaaaggaaggaccctgtattgttttcctaaagatgactgctgctaaaccaaatccatatgctgccaaaccgggcgactatctttctaatgtaaataatttccagttaatcgattcgacgctgagagaaggtgaacaatttgccaacgcattcttcgatactgaaaaaaagatcgaaattgctagagccttggacgatttcggtgtggactacatcgagttaacctcaccagtagcatctgaacaatcaagaaaggactgtgaagctatatgtaaactaggtttaaaggccaagatccttacacacattcgttgtcatatggatgacgccaaagtcgccgtagagactggtgtcgacggtgtcgatgtcgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtttcatgtgacatcgaatgccatttccacaacgatactggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcaagtccaaatacaagttgcacaagatcagagacattgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagaggtatatccacttcgccaacagactaactggctggaacgccatcaaagccagagtcgaccagttgaacttgaacttgacggatgaccaaatcaaggaagttactgctaagattaagaagctgggtgatgtcagatcgctgaatatcgatgatgttgactctatcatcaagaacttccacgcagaggtcagcactcctcaagtactatctgcaaaaaagaacaagaagaatgacagcgatgtaccggaactggccaccatccccgccgccaagcggactaagccatccgcctaacgttcccaaaccattacattatgttctttcacttattacatacgatatatagcatctacatctacatatctaaatgatgttttttcccatctactttgtccgatacgcattaaaagaagaagatttactctcccgtgatgccgggccaatcagacgcgcgcattcgcggcagaataaggggaggctgctgcgggtaccaaatatccagatattcacaattatgccaatcaactgtctagttgctgacacccatcgttttccactgcaacgaggttttggggctagaaaaggcgttaacaatcgttagagaaggaggggttcataacttgacttgttgtatcttgtttaaaactttctttgaatttgttcgtggttgaatttgtttttgctatcccaaaggagtgcattttacacgcattactacagcacacttttatacagttccacaatagaatatgttaccacgttcagcattagcacgctcattgcaattacagcgcggtgtggccgcaaggttctactctgaaggttctaccggcaccccaagagggtcaggctcagaggattcgtttgttaaaagggaaagggccacggaagacttcttcgttaggcagcgtgagaaggagcaactacgccatttgaaagaacaactggaaaaacaacgaaagaagattgattctttggaaaataaaattgactcgatgaccaaataatcatgcgtttccgcagaagcttttttttttttttttttagaatattcttactcttttatagtcaaacagcagaaaaactatataataatacatcacactgagcttttgcattttcgataactatcattctagttttcctctggtttgaattttcctcttgtctgtctgactaatgtcactcattatttccacttcgcgcaaagttcgtcccaatgcggaaaggcatagaaagataggaacagtgtggaacatggaaaagttccaaataacgtcaatagtccatacttaagatacgaaatttcaaaattccttcttttttgtttcaacaagcttagcctaacaccaagaatatacttagcatctcttcgcattcaaaatttctcttccattctttgacgttttaaatcatacctcgtattctttacacaaaagaaagatacctgtgaaatatatctgaatatggtccgattaaatcatgcagcatcatattttatgcctattttctgctccacaaggcctcacatagtgatactttctgcgctgtttagtatttcactgttttcactattctatgcgtcgtccgaattactgctacaccagtatgatgatccattgatgttcaaaccaaattcgcaggactatttcaggacctttcttttggggcttttttcaccatttctttattatttcctgaagacctttctattcaatataaatcaaaggtttttaatattgaacctgatagtggattttcctatcaacgacgtctttatgcttttgatactgattggtttagcgtaccctcaggtgcaagatcacgaaggcggtacgatcaagcataaggaatgttcttggcacatcattccaagacaagcctatatctttggtatatcatgggccctgggtgaattcaccatatgcataatagggaatttgtttaactaccaagaaatcgccgatccaaacattaatagtggcttcacacaccaggaaagcgccaacacttactgtaacaataatgatatgagccataacgatgactgcggttgtagtacagaatatcgccccaacgtcgtagacagaagtgatattacgttgtccaaatgtattgaagtaagaaatgactcatcttccatatcgaataacgtatactcgtctgagtaccatccaatcaaacctctacgttcatcgtcatcaacttatggcagcatacgacagcaacctcatgaaaataagaagcagctgcatgtaccagataattcgcaggacgatacaattatcatgatgaaccccatcgacaattcattaaagttgacaactctagatacgggtgatttgagtttccccatagacgaagaacagcccattttgaagaaatcttttggttatacatgggcagttcctaatgaaaatacacaaaatactactaaaagcttcacaccgataaagagatttattgcatttagcacggcataccagttggtcaccggtttattgttaatgatattggtagttggtagtaatatcatgttgacaattggggaatcattgattctgtcgatgtatttcgtctatgttcgcggccatgaaggattatttactcccgtggtgaactacttcggctcaagaaccatttcaaatttcatcttatgcgtaataattcctttcatatctctaaacttcctcatcaacacttcgatatatttaagaagagagctagacgattggtttaataattcacagggggagtttgaggacgacgacgaaaatactatcagtaagagagtagctacaaatcaagagtaccaacatccactgagtgctaattacatttcgatggatagtcctgatgtaataaatagcagcccgggtcacttcgggatgaattcaggccagttgttaggtaatacgacgttatattatggtagtttaaatggggatgatgatgatatgaccaacgactccgctttactaagattctgcaagaagctagtcaaaaattggagggctttggcaagaaatgattcttttgtacttggagtaatggtttcttggagtcttcttgtttttgtaacgggaatactttcaacagtttatatatagcatataagtaacgaccgtgcacatattagggtgttcatatcttgaaaaatctttatgttatccattttactttaggggaggtggagcttaataataaaatttacataagaacaacaatctgtaagtaattataaaaatatattaaagggacattttaaccctactttaaaagtttaactacatcagtggttcatcaatcaaaggttatgcaaggtagaaatttgtccaaaagaaaatagatcatgcatcattcaatatggagctcacactgtatgctacaatttggcctccattcataactgccaagataaaatttgttggcaatatggagctcacactgtatgctacaatttggcctccattcataactgccaagataaaatttgttggcaatattgaaaattcttaaattagcgctgcgcggaaaccagcgtcactaatttttttttttattgctgcactaaaaaaaaaccagctcaagtagataatcttacaagggacaagtagtcaagccttgcttattataattctgtttaacggtgcagtgagtttggacattcatgcaacgtggtaaatatgtgtctctttgcttctgtatttaagcatttgggcagcttgcggtcagtagaagagtgcatcgacattcatagatctctaataacatatatttaagtggatatacgcaaagaaaggacaagaaaacttgtttcggtaacagcattattaattctgaagaaatacgcacaaagagatgatttctgactacgatgctcttttgcaattcaacaaaaaacctgtttcgcaagaaatgattcagttcttagccacttctactgcttccataattaaaatcagggaaaataataatccaatccaaggatgtcgcccaccagacttatctatcttcattaaaaacgtggtaattcagtcaaatgttcaaacaccaactttaatggccacatcagtttatttaaacaaactgaaaagcgtaataccaaaaaatgtgtacggtattaacaccacaagacatcggatatttctcggatgcttgatattagctgccaaaactctgaacgattcttctccctggaacaaacactggaccacgtacacagaaggtttactcagaatacgtgaggtgaataccatcgaacgagaactattagaatatttaaattgggatgtgaggataactacaccggatttgattgattctctttcttacttcctcgggcctatcaaggaacaactatttttacaaaggagacaagaaatgctgttgttcaatgcaccaagtcccggccaactgaaagaatatataaatcatagaagaccggtttcgcattctagaacttcttctgctatatcggttccttcactgacatccatggcaacagtttcgacaacagactcaaggtcttctctactggcaaaataccaaccgtccctaccgttggtggaatctgacaacttcaacaaaaaaaatcatgtgccgttaaggaataataacgatatctgtaataatttcagggcagaggaaaacatacactcagtaaaccatattgatgtaacaatgggaagttcaccagtaatgtcgcataagcccacaattcaccaacggttaaattttacaaggaggggctggtcatcgtttttcaagcaataattctaagttactcgccttttacaagctctataaatattcttttccgttctttagttgtcttaactttgtacaatatgaataaccatcgtttctaggctactaaaaaaacaccatactacataaacaaatatctaataatgaatactcttggcattcgtcttgtttctcgaggaatatcggccgagtttttttcattttgacaggttatataattcaaaatctatctgactctgaaaaagtggtaataaatgcattgacaacttcttctctttattttacagacattaatccagcactacaagtggcatataacaagatgctaagaaacattttggtgagaagtactggcagcaatttcaaatttgctggcagatatatgaaatcatcagctcttttaggatactatagaagagttaactattattcgaccaagatacaaaccagactgactagcgaaaactatccagacgtgcatcgagaccctagattcaaaaaattaacgtccgatgatctaaattattttaaatctattttatcggaacaagaaatattaagagccagcgaatcagaggatctttcattttataatgaagattggatgagaaagtacaaaggacagtccaagttagtattgagacctaagtcagtggaaaaagtttctttaatcttaaattattgtaatgatgaaaaaattgccgttgtcccacaaggcggtaacacggggttggtaggtggttctgtgcccatttttgatgaattaattctatctttagcaaatttaaacaaaataagagattttgaccctgtatcaggtatcttgaagtgtgatgctggtgtaatcttggaaaatgctaacaattacgtaatggaacaaaattatatgtttccgttggatctgggagctaaaggttcctgccatgttggtggcgtggttgcaaccaacgctggaggactaaggttattgcgttatggctcactacatggaagcgttttaggcttagaggtggtaatgcccaatggtcaaattgttaatagcatgcattccatgagaaaagacaacaccggttatgatctgaaacagctgttcattggctcagaaggtactatcggtatcatcactggtgtttcaatcttgactgttcctaagccaaaagcgtttaatgtatcttacttgtctgttgaaagttttgaagacgttcaaaaagtcttcgtcagagccaggcaagaattatctgagattttatccgcttttgaatttatggatgctaaatctcaagtattggccaagagccaattgaaggatgctgccttccctttggaggatgagcatccattttatattcttatcgaaacgtcagggtcaaacaaagatcacgatgattccaaacttgaaacatttttagaaaacgtcatggaagagggcatagtaacggatggtgtagtggcacaagatgaaaccgaactccaaaacttgtggaagtggagagaaatgattccagaggcaagtcaagctaatggtggtgtttacaaatacgatgtttctttaccactaaaggacctatattctttggttgaagccactaatgcaagactttctgaagctgaattagtgggtgattcgcccaaaccagtggtgggcgccattggatacggtcacgtgggtgatggtaatctacacttaaatgttgcagttagagagtacaacaagaacattgaaaagactttggaaccatttgtctacgagtttgtttcctcaaaacatggttccgttagtgccgaacatgggctaggtttccaaaagaaaaattacattggctattctaagagcccggaagaggtcaagatgatgaaggatttgaaggttcattatgatcctaatggaattttaaacccttacaaatacatttgaaaataaaatgccaagttttatagttatctacatatgtatatatttatcaatattatattctacaattgtgtatattatatggtaagggtgatatttaaggaagaaatccacccttctttaaggtttccactgcacatgttgaaatgtgtctgaatcttgatgagcccaaaggcgtgccaccataccatctggtcactattaccaagacgttgaatatgtttgctctttcaagtaaggtcaataaacgctgtccagcaccagcttcgccacagtcagcacatccttgctcaatgttctttggctgcaccgttatgttccttgacttgttaacatgactattattactcttatttgctttattgcccttctttttctgctcttgttgtaagtgcaaattatttgatacctcggccgttctccaggcatacatgtgcatgtgggatgccttggagacgcttttgttgttttgcgttagttcttggagtatggagggtatatccttttgattttgtaatgggcaacatcttgcttgaaatttcgattttctatcaactaaaacttctgattcattccatattttcactagcttaccaacattcttactcatttctccaaaaaatagtaataccaaacatcaatacctatctaagaatctgtataatgtcttttctaaaggttttttacagctgatgattgatgcatgacttatttccacagtgccgtattttctcagttgccgttttgggtctgcttttcacaatgcgaagctttgttgaaaagagctctaaggtcaaaaacaatagtaagctgatcggtattaagtacttgccttcctgaaaattgctaacaaacatccaaatataccttccccatagttgaatggcatctaatagaacaaaaccaggttaagataggttttactttgagttgttaaatacacgcagaaagcgtctttccacataatctgaacattttgttatcgatggctactggcaggattcaatttgctgtttctactccctgcaatactaagggtaaaccgtctggttataggttatttgaatttaaaaacgatcgattagcactggtcccatcagaaagaggttgtacaaaagtagatgtgaatgcaaatatacaagcgttttgttatttaaggcctaatggtagagacacgtcaatatctccagacgcaacgcatattttggactcatgtgattacatggtgctggctaaatccaacggattcattgaaatcataagcaactatcaatacaagataaaaaatggcctgcgattagcgccctcttatatccttagatgtactccggaagatttcgaatccaatttttttagtgactatatgatcgctggtcttgaatatagtcaaggtttattatattgttgtatgtgctccggtcgaatatatgtctttgtaatgaaccttcccactgattacattcagtataagaacatgtacaaccccatgtttccagattgctttttcaaagtacatcacgataataatacaacacattcttcagaagaagaaaaattatttgaaggtagtacgcggtacactggaaggtcatgctctaagcatatctgctacttccttttgcctatagaaccatcccatttaagatcgtcacccgtggtatcttcgttttgcaatatgtatcaaggcctgcccatatataggccttcgatgtatttacatatagaacgaggtatttccacattccatataaatccattagaccggttttgtttcatgacagtatcgccacgatcaccactatttataaggaaaataattttaccattgacttatgttacatttttaagcacctttatcagcctaaagaacagtatacagggagatacatgcggtgagatactttcgtgggacaacgtagcgcaacaaaatggatttggttctttgttcagctggattagtaacaagtttacattcgatacggatattataaattcaaccatttgggatgatattgtaaaatattctggaacaggaatgctggattcaggaatcgtctggaaacagcgtcaaggtcacgctaaagatgacatatatgagttattccacactcaagatatgctgggaagtagtcgccgaaattcttcattcagtactgctagcagcgaaccgagaccgctgagtcgaagaaggagagaatcttttcaagccttaactagagacgcttttagagaaagaatggatgtaccctgttcaacgaagtgggaattagattcttttatccgaggattaagaaggaatacatttatggtagattttgaaattgttgaaaagatttctcatagaaatggaaatgatggggtgaatgaagatgataacactacagatgaaagtgatgaaacaatgacttcttttctaacagataattacaaaaagatggacattgtgtgcatcgatcatttcgtcacgttgagtgcattccgacctcggtactatgatgaaccaataattaaaatcgattcattatcgaacaaaaatggctctgaaaatggaactaatgaagaagagtgggcagaaagtcaaatgaaggtggatggccaagtgatagatgatgagacagctcaattcaagcaggcattgggaaatttatgttcattcaagaaattatttatgctggatgattctttatgctttatattggacacacatggagttttgttgataaatagatttgaaataaaaaataccaaaaatttgttaaggaattccaaggatactattcggataataccccatgatttcggattgattaatgatacaattgttataattaatgatatagacgtaggcacagacaatgtttgcgcccttacgtttcacttggtggtaacatcaatggcaggagagataactgttcttaaaggcgaatttttcaaaaactgcaggttaggaagaataaaactgtgcgattcactaaagctaaatagaaaagatcggtttgtcgacaaacttgctctaatcgattatgacggtttaaatgcacaaaaaagaaggttagattacgatgaaaaggacctttatacattcattgtgaaaaaggtaaaaagagactaaattgagttgcatagatgttagccataatagaaaatagcgtatgaggtagcaggagttataagacgtatttacgtatatgtatgtatatgttattattattacctgtgattgcacgaaggcctttttttttcacaacaagaagatgtaagaaatttacatgctattttgattaatggtcgaattaggtattgtctttaatctttcattaagaaaatataatgtaaccaagaacagcttgttaaagggcttcctatttaaagttatcttcttttccccaaggtaccactcctatatggttgataagaattgtagtttctgtaattggaagagttggaaatgctgttattatcaacataagtagaagggttatatctggagccatacatattctccgatatcgacgagacgtttacttttgtattttgataccgtgaatttttactaatattattattgagtgacagcgtctcgccccttatagttggttgaatgacattagacttttgataaggaggaggatggaagttcgatgctctacgtttatttctgccactatgagagtgatcgttttgggaatgtcttttatgggaaggtctcggtagtggatcctcatcgtatatggactcactaaattgatagtcttcattttcgtccgaatttctgttcatgtgacggtaatattcctgttttagctcaactgacaaattagaaccagtgaacgcacttccatcctcgttaggtactctagatgatcgtttttccttgcaatcatcaccaaagtgcccctttccaccgcagttataacagtatatagtatgaaagggaaggaccttgggcttagccttttcattatcatctactaaaatatatgctctccatatactaggacatctttcttttgagtgtttcttactcttacaaagagtgcactgaacttttttccatttatgtggacattgtgacctgtaatgacccacctcatcacactttgaacactggatagccttcggacaatgtcgagaataatgatcatccgtcgccccacagtacgaacatattatatggggacaatccttcttcaaatgacctctttgagagcaattattacatttaggtgctgcctctttaatggcatccttgtcatcatcgcttacgccaaaatatctaccctgccctctaagagctcttaattcgttgggattactatttacttcctctatagaaggtgctacaagtttatctggaggagttgtgggtgccgtatcgacgacaaatggtgccgtatttttttccatgactgcgaggaagtgatgtaagctgctatcgttgtacaggtaaggtttaattctctctgatgctgccaatagtcataacttttttcgaaatgtttcttcccatcccattagtgtttgaaggaaaaaaaggcactacccggatcatgaatacatttgatggtaataatatatatcacatttttaagcatgtattagctactgggaaagggcattttgaaatggtatgttttctttaaggatgaactatatatattacatgaaatatatttcaggtttacgtgaagggtgaaaaaggaaaatcagatactcacctgtaatcattagcgggctcgtttggatcagttttaaagattttgtccgggttcatgattctctttgggtcaatagctagcttaatctttctcatcaaatcgacgggtgcttcacctaattcttcgagcaagtactctcttttaccaataccaacaccgtgttcacccgtgcaagtgccttctgcgttcagtgctctcttgaccattctgtcaacaagttggctacaggtttcgtgttcttcaggggttctgtagacgatgaatgcatggaagttaccatcacctgcatgaccaacaatggcgttgatcagcttactagcttgcatgtcctttttagtttcgtgaataaccttgtcgaactgcgacacaggaacagctacatcagttgtccaaattttagctgatttgtctttgctcttatcagcgtctagcacagaccatagcgcgacctttctagcttcccataattccaatttttcgtcatcatctttagcaaactgaaaactgttgcagtgatttaactgggcgacagccttaacttcatccacaagagcattgacaatgttgggagatctcccaccaatcttgaaaaacatagttggtttctctacccaatcacatctgtccgtggattcagatgcgttgatcaacttcatcatattttcatccagtaactccatggcgttcaaatgaataccactctgagtcagattagaagcacatgcggccgcatccttgatagtatcaaaggataccaccgcaacagtttcagctttgggcttgacatgacacttgacagtagcttcagtaacaatacctaaggtaccttcacttcccacaaataaaccatttaagttatagccagcgctcgactttctgggtcttttcttcgtcttgacaatggtcccgtccggcaacactatagtcatgtttataatattctccttcatggtaccgtaacggtaggcgttggttcctgaacaagaattagcaatgcaaccaccaatctgtgcacctggaccagggtcacagccaaacatcaaaccgtggtcgctcaaatagtcattcaaatcctcccagggtagaccggcctgcacggtgatgtccaggtccagcttgtcaaattttacgacgttattcataaacttggacaggtctacggttatggtatctccaattcttgtaggcaggaagtgcccctccaaggacgttccgcccgagaagggtacaactggcatgttgttatcgtgacatattttcaaaattttggaaacttcttcggtagtatgagggaataatataatcctaggtctttgctcgggagaggggtgatgcgtgttgaagtaggtatctgaatgggcgtccaaatcggatttcgcatcagagtagttttcaggcttgtttcccagcacctgcttcaggtcctcaacaaccttatcgatcttaaccgggtcgtgcaaatagtctggtgagtccaatgaggacagctttaacgtagaatttactgggtcgatctttttgaccatttccagcttctctatcaaatcttccttagtctccctagaatagaggttcttagcgaacaaataaccgaatagagtagctgaagaggcgatgacagagtattttaaccactggctgctgctgtcggtgctgcctgtgcctgttgaggcgtatctgtagcatgatcttctcaccagccttcctctaggttgtgcaataggctttattagccttgtgcaagtacgcttccacaacattgttcttgcttttgtttccagctggatcggaatgatgtacaatatttaaattgcactataacacggaagctcaagaaatctttccagcccacacacacacacacatatatatatacatatgtagttccgagtgcaaaatcgctaagcggttattactgcaccagttggggccaactacgctggatcgacgtgggattggcagggaagaacttcgagggaggtggtcggagaagagagtgggatgcgggcgtgggggtctgctgttacttttatcggcacaacggacctgggttgacaagagcttgaaggctccaagagacagcgaccgtcggcgccgaatgacgaaactatgctgtgtgtgaccaggcgaacaacattgagagagttgaggagccgtacggacagctgtttgtagtgatatttccttgttgtaaccagacgagttcctttataacgttttgaaatgtttcatagggttaccctgacagagcggtggcttatgtcaaaaaggctgacgctgatactaatgacggtcaatggaagcatatgagcaaaagcagcagcagcgttagcagcagcagtagcgtaagaccaagttagtatggctacgttcaacccacaaaacgagatggagaaccaggcacgtgtacaagagtacaaggtctccactggcagaggcggagctggcaacatccataaatctatgtccaagccgtctcccgtacttcttccattgaaatccaattcaaagacagtagcaaacaacaataataacggtagcaaccaggaaaaggttcctcgttttgcaattggtagaggtggtgccggtaatatctttcatgatccgcacctgacgagatccgcccaacaactggactctaacgacaatatcaactataacgacgtgatcaatgacatcgacgattatatttcccctataacttcggatatggtggatgaaggtgggtcaaacccggtgaccaacaccaggtctcgtatcagcgctacaaggagccatcagtctttgcatgccaccacttcgtctccgaacaacaacgccccaattgtcgttggtagaggtggggcaggaaacattttcttcaacaaaaaaaaggtggccagcaatggtggaaatgaagaggatgagatacgaggcggcaatatcgaggatgaggatactatcaatgcaaacgaggacaacctgtttgtggtgacttccaatggcaatgctttggcggcaatcaagtccacgtccaagaagcctaaaaataagctcaagggcaaaagcgcaccggaaaaatttgctattggaagaggtggcgctggaaacataatttctccaaagtcaagcaggaacactatcaaccataacttaaacgatgatgatgaagataagtttaatttgaaagatgacaatggtaaagagaagaagaagaagaagaagaagaaatcagggtttttcagttctttgaaaactatgtttaattgaaataacattcatcagcaaaattaataaactaaataaaataaataaataaataaataaataaataaataaataaataaataaataaataatatacgatcataaaataaataataactcaagctttttagacttgactagctaattctttcaatagtttgtaatcacgttgaacgataccaccattacttggtagatacgtagtgccgtccattaggaacttatcgacagaggcagcacattttctaccttcttggatggcccagacaatcaaagattgccctcttctacagtcaccacatgcaaaagtctttcctccatcaatagagtatgaggagtcgtcgagtgtggcaatcgtaccacgtcttgtcttcttaacttcgttatcgttgccattgatcaattcaggacccacgaaacccatagacaacaaaatgatatcggcttcaaagatctcttcactgttgggaatttctaccatttgccatacgccactttgtgacttcttccattctacgcgcacagttctgatggcagtgacttcaccctcatcgttaccgataaattccttggacaagatgcagtattcacgagggtctctaccataatgctctttcacttcagcatgaccgtagtccactctcatgacacgcggccattgaggccatggattgtctttggcacgttccactggtggctcaggcaacaattcgaaattcaaaactgatgctgcaccgtgtcttacagatgtacctaaacaatcgttacctgtgtcaccaccaccgacaacaattactttcttaccttggatcttttcacgaatgatttccagatctttgttcaataaagcttttgtgttagattccaacaactgcatggcaaaatcaatattcttcaattcacgacccttaataggtaagtcacgtggaatggtagaaccgatagcatacactactgcattgtgcttgttctttagctcatccatgcttatggttttaccaatttcggtgttggtaacaaagtcaataccttcggcactcaatagatcaatacgacgttgcactatagccttatccaacttcatgtttggaataccatacatcaataacccaccacaacggtcggatctttcataaacagtgaccgtatgtccggcacggttcaacatatcagcacacgctaaacctgctggaccagaaccaatgacacccactgtaaagccagtgcgtgtacttggtggacaaggcttaatccatccttccttgaaagcattgtcaatgataattctttcaaccgattttatgccgactgggtcttcaataatacctagtgtacaagctccctcacagggtgctggacatactcttccagtgaattctgggaaattgtttgtctctagcaatttgtccagtgccaacttccattggttcttgaataacaattcattaaacttggggataatgttagataggggacaaccggtatcagataaacagaatggtgtaccacaatccatacatctcgcagtttgatatttggcatccttcttggtaatagggttagtaaattctttccagtcattaactctggttcttggatctctgtgtgtctcatgacgacgtttgtggatcataaaaccacgtgttttttcaatcctttcgctattcttctctagctgtttggaatctggaactgcatcttctaaatcaacaaccttaggctccttcaaagtggccttatttgaaatagtaatactcttctttttttcttgctctttagctttttgattagcaatcaatagagtattgacttcgtcatcaacttcttggttcgatctaaacttctttaagtattctgaagttgccttagcctttgccttggcagcttctgctttctccttcaacaaaactttcttataatcagttggaatgactttaacgaaatctttcaaataatggttgaaattaccgagaatcctggctgctagatcagattgtgtgtagttccaatgctcctggatcaaattcttaacaaacgcaatctcgaccgggtcacataatgattctaactcaacagtatctttgttaatctttccaacaaaatcgtcgtaatcggaagttaaacagtatgcaataccaccagtagcaccagagaaggcgtttagggattccatttgtgataagacaatggcacgaccaccagtcatatactcaaaggcattgttacccttaattctctcaacaacgatggtggcaccagagtttctgacaccgaaacgctcaccggcactacctgaaatgaatgcagtaccagaagtagcaccatagaaacaagtgttaccaacaattacattttcatcactcttgaatttagaatcctttggtggtttaatgacaataataccaccggataaacctttaccaacataatcattagcatcaccattcaagataaaagtgataccagaagctaggaaagcaccaaaagattgacccgctgaaccttctatgttaacgacaacggtgtcctttggcaaaccatcttcaccaaatttcttcgagactctgtaagataaagtagaaccgagtgcacgatcagtattgattatagaggcgtcaatattcactggtaagccacgatccaaagtaacttcagcctcatcgattaacttattatctagacgggtgtggagtttgtggtcttgtttcttagtgaacttggttggaacacctggacgaataacatgtgctggggtcaaaataggagataaatcgatatttatggctttggcatttacgtcgtcccttttctttaatttttcagaatgacccaccatttcgtcaatggtacggaatcctaacttggccatgatttgtcttaaatcttggatcaagtaatagaagaagttgataacatgttcgggctgacccttaaacttacttctcaaatatggatcttgtgtggcaataccaacagcacaagagttcaagtgacatcttcttaacataacacaacccatagcaattaatggaactgttgccaaggtaaaagattctgcccctaataaaactgcaacagcaatatcaaacccagttctcaattgaccatcggtttggacaacaacattacgtcttaaatcattcaagactaaagtctggtgagtttcagctagacctaattcccatggcaaacccgcatatttgacactcgtccatcttgcagcacctgtaccaccatcatgaccagaaactaagatatgatcggctttagccttagctacaccagaggcaacaataccaacaccaacttcggaaaccaactttacagaaattcccgctcttggattagcacatttcaaatcataaatcagttgtttcaaatcttcaatggaataaatatcgtgatgaggaggaggagagattaacccaacattaggggtggagtgcctggtttttgcgatatccttagacactttgtgggctggtagttcaccaccttcacccggcttagcaccctgagcaatcttaatttggatttcatcagcatctgacaagtagtatgaagttacaccgaatctagcggaagcaacttgtttgatagcagatctcatagtatcaccgttttcttgaacagcagaacgttctgcgtcttcaccaccttcaccacaattggatttggcccctaaacgattcatggcaatagccaatgtagagtgagcttccatagaaatagaaccataagacattgcacctgacgcaaatcttctggcaatttcagtccatggttcaacttgttctagagggatactgacagaattttcaaaatctaattctaacagtcctcttagtgtacagtctctaattgcttccatttccttctttacatataattgccaagagacatcatttttgtttctgacagtatcttgtaacgaagcaattgcggttggttcgttgacgtgtttgtaaccaccatccctaaagtggtattcaccactttctggtaagttaacagatttactaatggtttgtctggatggataaccacgctcatgtaaagaaaaggcatcttgagccaaatactcgaaagttacacctctaattctggaagaagtacctgtgaaacacaaatcaacaatagagttatctaaacctagggcttcaaaaatttgagcacctttgtaggatgctagagtggagatacccattttagacataaccttcaagatacctgcatcaatagcgtgcttgtaattttctagtatttgcccttcctcaagtgtatcattgtcattgttgacattacgaagtagaccttctctattcattctgaccaaagtttccatggctaagtatggataaacaccatcacaaccataacctagtaggacacagaaatggtgaatttctctggcttcacctgtttccaaaatcaaagcaacttgggaacgctgcttgtttctgattaggtgatgatgaatacatgaaattgcaatcaaagaggagatggaaacacggttggcacccattttcctgtcagtaattattaagatctttttaccatcatcaattgcttcgctcgctaacttagtgattttatcaattgtgtcggtatagcccaatagaccctcactcttgtcgaatgtgatatcaatttctgctacagaccatgatgggtaagcagcttcaatgtttttcaaagcttggaactcattccaatgcaaaataggagatttcaataataaacgatcacattgagatgaatgcatttccaaaaggttgccttgaggtccgacataacattctaacgacataacatttgcttcacgaattgggtcaattggaggattggtcacttgagcaaacaattgtctgaaataatcataaagtaagacaggattttcatttaaacaagccagtggcgcatcgttacccatcgaacctaaagcttctttacctgttaaagccattggagttaacagaaatgtgacttgttcgaaggtataaccattggccaatagacgtgggtcactttgaactttcaaagacaatgaatcctgtgatataaattctttaggaaccaaattagcggtttttgataacaagtcgtctaacttgatgactttggataaccaagacttaaaatcttgtctttttgagatttgagattttaactttttagtatcgaccatttcacccaattgagtatccactaggaataaatcacctggcttcagtttacctttttgaacaaccaatgaattttcgataggaatgacacctacctctgaagcacagataactctgtcatcactagtgatgtaataacgacaaggtcttaaaccatttctatccaatatagcaccacagtaacgtccatcagtgaaagttaacaaagctggaccatcccaaggttccatcagacatgcagcccagtcgtaccatgcttttaggtcagaatccatatccttatgatacgcttcaggaaccatcatcataacagcttcaggtagagataatgtgccattaatagtcaatagttctaaaacgttatccaatgcagctgaatcagaaccaccttcttcgataattgggtatagtttgtctaactcatctttgaaagttgctgaattcatcacaccttctctggagcgcatccaattcttgttacctcttaaggtgttaatttcaccattatgagctagccaacgtaaaggttgagctctatcccaagaggggaaagtattagtggaaaatcttgaatggaccaacgccatgtgggatttgaaatgcgcattagtcaagtcgggatagtagttatacacttgagctggcgtcaattgacccttgtaaacaatggtggtattgtttagggaacaaacatagaaccagttttccagtcctatttgaagagaggcctccttccttaaaagatacaattgagttctaaatttagtttcattaaactccggttgtttttcatcatacaatggaaccaataatggctgtagaatagtaggttcacgagataatgcaacgtctcctaaaatagtagaatctacggggacgtttctccaacctaatacggataagttgaaggatgcagctaaatcctcgaaaatcttctgacacttaattaaatttttcttgttatttttttcgttcttcttgaagaagacgttacctacggcgtatttgcccatctcaggtatgtctagatcaagatctaacttgaattctcttttcataaattcgtgaggaatacctagcagaataccggcaccgtcaccgttcccatcagatgagacggcaccacgatgtgtcatattcactaaaagatatctagcgtcagtaacaatcttgtgagactgttcaccatgcttatttgctacgaaaccgacaccacaagcgtcatgttcataatcagggtcgtaaagtcctcgtttgtccggaatcacatttgcccaagatttatgaagatggtgttcatcgttatagttttgaattgtcccaccttcgtaagcttcttccaatggatcgaaattgtctgatttcaacactggcatgctttcttttctaattctttttctagttcttcaaaataaataaatggcaaatagattaagaaaaaagagagagtagaaagacaaaaataaataaaaaaaaactgaagcagaaaaataaataaataagttaaacgttaatcactacctcaatgagctaaaagaaggggaagaaagagcaactgagagtatccgtctgcgtagtataggactgagatagcaatttcctatcttcctatgatgtggagacgattagtttggtgtgttatcaagtaagatataagaattgattaatttggtaagaaatgaaacaataggacgaaaaatacaataagataaggaagaccatcagaacttatgaatgactaagaaaagcagtttatattttttttttgggcaatttattgcttcttttttttacgttttgcgggcatcacgttcgtcgtgacatatgacttgaaaaatgtgcaaaagcttatcggagccaatcggattgacgcattaaaaccgaagtgtattaggaccaaatttgcgctgtatagggttgaacggtagggctaccagggtctgagtcatcaaagaaaaagaaattacaataagagtcttacttaagatgatatagaattgttgttattgttcatgtatggatgccaagaaaacaaagttttttaaagtgaggtatgaattatggcgtggagaagctgaaattgaaatattcgaagcatgggtgtattacttgcaagatcagaaagaagagatgctctgaagataaacctgtgtgccgggactgtcgtcgattaagttttccctgtatctatatatcagaatctgttgataagcagtctttgaaaaaaataaaggcagatatacagcaccagttgatcagcaagaaaagaaagcatgctcctgacagtgctcagaaagcggccgtggccacccgtactcgacgggtcggtagcgacgaacaggataaccaggtatatttgtcaaaaccgctggaagattgcatttctcagaagctggactctatgggattgcagctgtacaactactacaggtctcaccttgcaaacataatttccatcgcgcccatgaaccagaactactatctgaacattttcttgccaatggcccacgagaatgatggtatattgtttgctattcttgcttggtcagctaatcatttgtctatatcatcatcaaatgagctgcgaaaggatgaaatatttgtcaacttggcgaacaagtatacatacatgtcgttatcgcatctaaagacaaacgagggctcaagtgcctgtgctaaactggggtttctatattcactagcacaaatcctaatcttatgtggttcagagatatgtcagggtgatgtgaaattttggaagatattattgaatataggaaaaaatttgatcgaaaaccatgtgggcaaggatgtctcacggatactaaccactactacagaagaaccctccctagaggagaggataatcttccccaatttcaattccgttgttaagtactggctgattgtgaattttatatatcatgatattttgaatttcaatacaacgtccttcccgatcgaacaatacgagaaattcttccaaagggatcagaactctttacccagctcagccaactttattgagtcaatagactcgccaattgaggaaatagaccctttaattggcatcaacaagcctattttactactattgggacaagtcacaaatttgacgaggtttttgcagactatggaacaggaagaaatgctagagcatggcgataaaattttgagtttgcaagtcgagatttataaattacaaccttcgcttatggcgctggaacatttggatgatgaaaagaaattttactatttagaactattcgagataatgaaaatttctaccttaatgttctttcaattaactttattaaagattgacaaagattcgctggaactacagatactgagaaacaaattggactcgaagctagacaaggtcatcggaacttttttggaaggatcgttatgcttcccacttttcatttacggtgtatgcattcaggtagaagatatggagaaaaaaatagatttggaagccaaatttgacgacattttaaaacgatataaatgttacaatttccaaaatgctagattattgatacggaaaatttggcaaaacgaggctgatggcatcagtgagcatgacctggtccacatgattgacgaattagattacaatattaattttgcctgagcagcatatattttctttccccgccccctgggtgtcttaaattattgtttcaccacacaaacatatatatgttcttttttttttttgtaggacgtacggattcaaaaacaatttatacctatacaatgtagaaatgctaacgttgagacatagaagtaattatttaattaaccattttaggtgattattttcaggggtgtccgagtccacctctacaacatccacctgcccggtttgatacctgtaatcgcctgtcttggagtcctccacaaagcttatgcttctctcagatttcctgcgtggcctatccattatggctgctcctgcatacgacgtgccagtgccgccaatcatatctatatcatgattgctttccccgtcgcttgtactatcttcattcgagtggacgtcatgagcccatacagatttataccgatttgctctcggaaattcatggccatctagcacttgtattctttggtagtgatcactatcattatcctcgtcactctcgtccctttcacaaacggggctttcccttctctgctttgcagtccttgttaatttagtcttagacttcattttagctcttttattagattttgtctttaatttgcccttgatcttcaaaattaactcatcaaagttgtcctcgtgtgcatcatataccaccttatatgattgttggtattgtgtggcgaataagtcctggttccaggcaaaaccttgactttgagatacagatattttaaaatttggccttatttctgcactatatgtaaataccgaactggtatttgagtatacaataagtttctccttatcctccatgactcttcagtagcggttatgaacacgatataactatctgcatttaacgctggtactgatttcaatttatccttatcaaatgatacgctctttccctttaaaaagcgcccttacctcgttccgaacggcgctagtaagaatttcatcaaattgcccttcttgtggggggatgctcatcacagactactgaatatgcatcacagaaaagacaaaaagaaccattaacatgattctgcatatatttgaatgattaatccatggtattgatttaaggcggtaagaaggaaaatttaaaatttggatattaccatcttcttctacactcatatatattcctaatttcctttgcatcaggtcaatcgtgacagttgttgcttataaatgcgattattttctgcgtaatatccataattacttcaagaaccccttaggtgacaaccgaaagtcagcagtcacttaatagtatttagtgtcagaatttgttggcctattttcttacattcactatataatacttacggggctagttttattttctaccacaaataaaaataaagcatcttttaattttcttcccttgaatggcttaagtgcctcagtcgaatggcaacttggttccattattatcaactgtatactattatagaggcatttttttcaataaagacatgcggtgtgtgggtctttttacctctgtaagttacgtaataatggaatttcatagaggaagaaagatgaaaaaattcacttataaagggaaggacatccgtgtgcttataccagcttgagaaagtactgacccttgaatcgttaagtttacttctacaaaatctccaagtaaagaaggaatataagtaatataagtacaatgtccgccgctactgttggtaaacctattaagtgcattgctgctgttgcgtatgatgcgaagaaaccattaagtgttgaagaaatcacggtagacgccccaaaagcgcacgaagtacgtatcaaaattgaatatactgctgtatgccacactgatgcgtacactttatcaggctctgatccagaaggacttttcccttgcgttctgggccacgaaggagccggtatcgtagaatctgtaggcgatgatgtcataacagttaagcctggtgatcatgttattgctttgtacactgctgagtgtggcaaatgtaagttctgtacttccggtaaaaccaacttatgtggtgctgttagagctactcaagggaaaggtgtaatgcctgatgggaccacaagatttcataatgcgaaaggtgaagatatataccatttcatgggttgctctactttttccgaatatactgtggtggcagatgtctctgtggttgccatcgatccaaaagctcccttggatgctgcctgtttactgggttgtggtgttactactggttttggggcggctcttaagacagctaatgtgcaaaaaggcgataccgttgcagtatttggctgcgggactgtaggactctccgttatccaaggtgcaaagttaaggggcgcttccaagatcattgccattgacattaacaataagaaaaaacaatattgttctcaatttggtgccacggattttgttaatcccaaggaagatttggccaaagatcaaactatcgttgaaaagttaattgaaatgactgatgggggtctggattttacttttgactgtactggtaataccaaaattatgagagatgctttggaagcctgtcataaaggttggggtcaatctattatcattggtgtggctgccgctggtgaagaaatttctacaaggccgttccagctggtcactggtagagtgtggaaaggctctgcttttggtggcatcaaaggtagatctgaaatgggcggtttaattaaagactatcaaaaaggtgccttaaaagtcgaagaatttatcactcacaggagaccattcaaagaaatcaatcaagcctttgaagatttgcataacggtgattgcttaagaaccgtcttgaagtctgatgaaataaaataggagtacttaattaaactaagtaagcatgactcaaattttctggaatactttgaaaatcaacgtcctacattctatcaaatatcatatatatgcgcacaattacgttcttcagcaatcagttagacctgaagaaaaaagtaagggtagaaaaagtatataaatatataaaagtgtaaaaataaaaaatacaatgtggttgtgtgaaatttattgacctcgcctgttcctaactaccaacgtattgaactattaaaaccattaccgaaagcgctattatcaccaacattggaaaaattaacgttagctttgtcacttttgaactcgttaaacgagctaccattcccatctccctccttcattgactttgttgccatcgataacggtggtgacataaattccatcaaactaatatcacgacctttgttatcgttcccatcggtgcgaccagcattgctaccaccattagtattaacagaaatattgttattactgggagtacgcgacgctggtccaaatgttgatgaatctatgtaatgattggtttcacttgcatcgccgcttattgattttggaccaccacagcgtaagcacactacgtttttagcaaagttatgatacgtgcacgtggaacacttccaatctcctgctctaaatggcatgttggagccacatcctcccataccgatattggaattacaattattactattgttaccattgttattattattattattattggtattactattactattgatactaccattatgatgattgttattatgattgttattatgattgttattgttattactgttgttcccattaccattcccattaccgttgatgttgttattaatgttatatctattattggtcatattgttaatattattgttgttattgttaatattattattataacgataatttggggctatattattatttcccgaaaaatgatccgctataattatcggcgacccactgttcgatggtgccatgttcaatgaattttgtcgcgacaatggcgtaattgcaggaaaatgagctctattgtatgttaaagctgctggcgtgttgttagcaatcatgttgaactcaggggcaccataggggtgattcgctgcagtgttactaatattgcttgaagatcccgagttcacgcgattgtttaaattatttctactactgttaacattattgtttgagttcgcagtatgtatttgactatttgatggtgccggaaaagaacatctaaaacatgcagtacgtctttgaaagtttgaaaaaccacaagatgggcaattccagtcacctggtcttggtttgtttttactttgagggaaaggcgataaaatttcttgagccttatcgagtactccggtggaagaaggttgaagctcaaggacatgttccaccacccttggttgcttagtgtttgccagattagataggattgatctcccattcaacgctagtacttcagttgcttcttcatgtgtttggaagacaacaaatcctgagatactatcttgatcttccacatagggactgttatttagactccagttattattaacgttagacgtatcttctacgatgtttttgacagtccaaaacccaactggtctaacaccatattgggtaaaccatgattccaactcactttgagttgtgtcgggcggtaaattgttcatgtacaaaatcttagatttctcttgcaaaaacgctctaatatcggtgtgtgagtcatatggttttgttaagacagattccatatcttcaggggaagtacactttttgtgcaattgtattaatatatccgttgtcctttttaaaagagagtatatctctggaacagagcctgcctcttcagttgggattgaaacttccaatattctaactatttcgtccaaatccttcgtatttttggctgcattaatactaatacttttagtattacaattgttgttggagattgctttcttttgtcccaaaatctccggatggttgacacaccatctatcgaattccttccataagtcaaatactttcggatgttgtaaataagaagtaagaataaacccatcatctctcgcttgacgtggtaaggtaacacggatatgccatgttgaatacagggaaacaagaacaaagtcgtcgttaccaataacgtcatgaatatccttgtccaattgcaccattgcactctccaaactctttgtcgtcccgtttacttcaatgctcggtaaagaattggtcccataatggcatactaatgtttcagcattcacaatttgaaatgctatattcgcaatgcgacattgatccttgggggtatctggcaaatgcgcaacttgcagctctagtaccacatagtgcataatttctgtatcaaaaatcacaatagcaatgcacaattatcctagcgctcttctttagtaatgctatttgcatcaaaaccaacttattaaacttgtatgtgttgaaaaatttttcactttaaacttttccactgggcatcggcatcggagaatgaaaatatattaccaaagtcacattaaacaagtacatgacattacttaaagaaaaccctttataataggcactactattactactgttactaatttacaattatatatgtatatatgtagatacacaaagttatggaacgcctactcactgtcttcatcgtcttcgtcatcgctacgaggcccttgatattcatttgtgactccatctggatgttgttctaaccacatcttttcccaagcaacaatacgggatacgttagataccatatcttctttcgtatcgctttgtagctctaccacaatgtgcggttcgtatgattccacggcatcctgtttgacgacacccataatctcggcatcgaggttttcctcgatcttagagtcatgatagcctcttgcatgcaatcttgaatacaagttagagttatcgcatctcaacaccaccaccaagtcaatcagcctctctgggaacacatcattgacatgccaatcgacaatactatttccctgtctcaaaagaggctctagcatgtccagcagtttgtcttcatcgacaatgtgcgatttacggccctcatcatatccttcgaaacagtcgttatctttggcgaaatccgaaatgttatagtatttgtaatccttcagtttattttttaaaaactcacacgtagacgacttgccacatcctggtgttcctgtaacaatgatattcggtccataccgtcttgcttccatctttatataacaaagtatttctttattttctaatagttcctttctacgagtcttgtgtatgatttataaagagtgagctcttttgttatgaagtatattattatgtgagtatttttttataactgcgaaaaagcgaggcgaacattaataagataatagcaaaacaggcattttttaaactagatatgcaaaaaccacaaggaaaaacaggaagagaagagaatcaaaatatactattccctacataatggaaaaatttggtttaaaagcgctagtaccgctccttaagctagaggacaaagaactttcaagtacatatgaccattccatgaccttaggagcggacttatcgtcgatgctatattcgttgggtattccaagagattcacaagatcacagagtcctcgatacttttcaatcaccgtgggcagaaacatccagaagcgaagtggagccccgatttttcacaccagaatcattcaccaatattccgggcgtattacaatccactgtaactccaccatgcttcaattccatccaaaatgaccaacagcgtgttgccctttttcaagatgaaactctatttttcctcttctataaacaccctggtacagtcatccaggaactaacgtatttggaactcaggaaaaggaactggagataccacaagacgttgaaggcctggctcaccaaagatcctatgatggaacctattgtatccgctgatggtttaagtgaaaggggatcatatgtgttttttgacccacaaaggtgggaaaagtgccaaagagatttcttattgttttataatgctattatgtaaggtagacagagaaacgaaagaagtaaataaatgtcattatatgtgatgcggcgttttggagctgaacagaacgccctcttttttttttttaatgattaattgagaaaaatagtgtgcacatctaattttgcatgtgggattggttttcatacaattcgacgatctggtcagaagaggttgcatcttctacgcccttgtcttctcttatacgcaaaaatcttggaaatcttaaggatacgcctttatcaaaagttgcactacctgctttataaataggcgatagggaaaggtctgcagtcaaaacttcaaacaaagtcgtaggttcgaaccatacatctggctcagcactcgaatcgaaaacaaacgtggcttttggtccatcaatgatcgtcggggtcaacctgtcgtgcaaaagctgcaacatttcgtccgaaaatcctgtccctatcttgcaacaagtttcaaattctcctgtgtcttggttgtaacatcctagaaggaacccaccgtacgtaccagttctttttcctctaccataatatgcccccaacacgcagagatccaatgaatctccaaccccctccaagtaatctttttttaatttcaaccagtttcttgaccttttacttggttcataatgggattcagggccctccaacattttgaccatcaaaccttcgcatgagtgattaacggactcatcaaggaatttttgaagttcatcaaggttatttgttgttatctgagtcgcgtattggaattctcccgggacaacttttgtaaccttcgtcaagtattctcttctttcctttagtgacttattaatcagcctttcatcgttgtagcaaagtatatcaaatgcaaagagacagactttaactttaacatcattcagctccacgtctttacgtttccttgtacttaagacctggaaaggcaaaattttcccctgatctttgtcccaagcaacagcctcacagtctagaattaaatttttggtagtatccaaatcctggataaaatccgttatgttaatttctggatatctctcagtcatattctcgccatttctggaataaatcctcattgtaccatcatttagtaaatgcacctgagccctttcaccatcgtatttgtattctgacgtaaaagtttcgccttgaaatctatccaatacttcattaattgccttggtaggcttggctaacatgggtttcaatggaattcctggtcttagagtacaatatttatctaaattcataataccgtgttccaggcatgagtttataacaatttcatagttgggtacttgacaaaatgcgtctcttatcttttgttgagcactttctaacacatccatggggacatctttgtctggagagtcctccctattttcatcatggagcaaaagagccttcgatagggatattaagacagtcttttcagcaagaccgattctcaattttgactctagggatctaatcaaaaacttagcctctatacctttgcaagcagtaagcattctcttgatcagcttcatcttttttaattgtgaatctttgccctgagtcttagcaatagctctaagatttttgaagacctcacccacggtcaagggtttgggcttaaacatagtgggttggacatttctcgcacccattgctatttcacccaaatccccaatatccttgtatttaagtttaatttggctcatggatttcccgcaagtttcgcttatggttttcataagaagattttctccaaggcctaattccaagcctgcttcgtagtcagggcccaatctattgatgaaaaggtatgttgtaggtattaagttcttagacgattgcttcattatcttaataaagaaatcagaacagattcttataatctctaaacgggaagatatggcctcaatcttgttaaaaacctcacaaacttcagaataggggatattagacgaatagtgatcattattatttgagctcaaggcgtcttcaacttcacctaccaacctctgagattgttgcggtgaatcagcaacaccggaagagggagcggatgatggtatagaagaaaaattgctacccatggagcttggagctgctacagtatgtgtaacagccgtctgtttcaatttcttggtcgcgtattcctcttccccactaacattatccattctatcttccagcatatgtttggatgattttttgggagaaggagtaccttctgttggcttatttttcatggaagtgaagaatctagccaaagtggcttgtttaggcttcttaccggcagaggaaggtaatgaggatgacatcaataatggcaatcttgatttcaagggacgtgcagatgaaagaaggcaaccggtcagtaatctgcgcatgtaattgatgaacaatgacgttaaaagctgctctaaacctccaaaatcattacttttatttttgaacaaagtacagcgagatgcaaacgcatggcttattgcagctaaatttcactttcacgcgttttcgcgttaaggtgaaaaattccatcagccatctcaagtggaggaacacatcgaagcgagcaaaaagatgacagagttaaacagcaatagaaccagcggctgcagtacgaattcctattgcaagtcttacggaaggttggtggggccttatgttgttcaaagtacttgattttggaagtatggttgtctgaaattgtggctacgtatagagaatcatccgggtaatgatgaaagtttctttcaatgacaaataggagttttaagaagtagaagaaagagccgttcgtatgagtgccaggatcagaaggaaagggagcaagaggcagaacaatcatgtcgaaacaatttgttagatctgcgaagaatttggtgaaagggtactcttctacccaggtcctggtaagaaatgcaacgtcaaacgacaatcatcaagtgtccaaggactcgttaattgagctggctgaaaaatcatatgatagcgcagatttcttcgaaatcatggatatgctggacaaaagacttaacgacaagggcaaatactggaggcatatcgcaaaggcattgacagtaatagattacttgatcaggtttggtagtgagaattgtgttctttggtgtagagaaaatttatacatcatcaagacattgaaggagttcaggcacgaggacgatgagggcatagatcaaggtcaaatcgttagggtcaaagcaaaagaattgactgcattactatctgatgacgaaagactgaacgaggaaaggaacatgaatatcaagggaagaaacaggaaaggaagaagaagaaggggaactgggcgcagtgatgaaaatgacgatgatttgcaaagagccattagtgctagcaggttgacggcggaagaagacgaaagaagaagaaaacaggacgaggattatgaaacagctttgcagttgagcaaagaagaagaggagctaaaaagattgcaagatttacaaagaatgcaacaacagcaaggccaacaacaattgcaacaacctatgtattatgatatttttggtaacccaatcactcctgaggaatacgcacaatttcaattgcaacaacagcaacaacagcaacaacaacagttgcaacaacaaccaatgtactacgatgtattcgggaatcctataacacccgaagaactagcacagtttcaacaacaacaacaactacaggaacaacagtacttagcttctatgcaacagcagcaacaggcaatgtccaacaatccatttgccaaatcagaacagagctcaagttcaccaaaacggaaccaactagtagcagcttcttctccacagcaactgcaacaacaaaaacaacaagagccattgattcaaaacaggacaggcaatcaatcaatgacagacaagtatagtaaactaaacgagctactagccacaggaacaggtattgatacattcggaaatgtaggggaggctcgtattcctgcccaacatacgaagacaggaacattcatcaattctcaaggaacaggatataggcaagtatcggatgatccaaaccacaatccgtttttgaacagtcagtatacaggtttaccaagcactagcgtcgtaccaacacaaacaggctatggctttggtaaccagtctcaacagcagtctcaaaataatggctcaaataaccggggatatactctaattgatttatgaagtgattctgtcattccagtccgcatttctaatcagatgagcattttctcgcatcgcataatatatatggactaagtaatttaatcatttcacagcgcgttttgatgcaagcgtttagtataaaatgaactgtatatttgtatatgtgagcgcacgatcgctccaaaaactactttagtaaactaacgtagttcaggacgactgaaagaaaatatagtgctttaaatttatcagacaaccaggaatgtcttatgtctttacatggatgtaatgtaagttgaatacttttacatatccatcagaagaagccctacgatacgctctaaatcttgatgcgataactctaagggacttttatcgccacgttctccgttaatgtccttgtgagattgcaaggaccgcagcaccgcctcatcaatgaatatatccaaatatttctgtatcattggtactacttcatcggcaattttcatatcattaccaccttcattttggctgaggatttttattaacgcttctttagataacatcaccacaattactgtgctctgtactcatgtcctttctaagtgcaataatgtaaattctaacacgcttttatgtatgattgatttttgatattttggcccgaaagataattctggtctcccggaaacatgaagatgcagcaaagtaaaaaataataggtaaaaataataaaaatacatgtatctttttggttggttaatttatctaaacagttttatatatatatgtatatatatatatatatatacacagtattaatattctttccttgagattactctctataaaaaaaaaaaaaaaaaagcttttaaaaaaaaaaaaactcaaaaaaagaaagaatattcaaagaaagtttcatcttgtcagttgaaatgaatagtttattgtggaaattataacaataaaagttagctaaaagcgaaagtgtcgatgaaactgggcaagtgcacttgagctcttgatatggacggtagtattggttacaacaatgactggtaaaagaatgaagtggtttgagataattttagagaaacaaaaagaaataacaaagtgatagtaataaaaacggtgcgcaaatgaggataaaaaaatcagcacagaaactagagaaaacggataaaaaaataaaaaagcagagacaaaaattaaattacgactgattcttgttcaaaatcaatagtaaaagtatggttacaaagtaatgtaattcacaatggagatttgaaaaaagataaaaataatcgacgattagatcacaaaaaaagcgtatctcaccacagtagttattttttcttagatattctttaatactggggttgtgactgaccaggtggcatcgccatgaaatgttcctgctgtggaggatacccctgctgcgatggcatttgcggtggaggatacgcctgttgttgctgatgcgaaggaggaaccatgaattgtggatgatgttgctgcggaggaatagcaaattgttgctgagatggtaattgttgctgaggtatcgcttgttgatgatagctctgttgctctatcgggaatgggacaggtaccgtttcgtcattttcagccacatacaatgacttatcgatagtggccggaatagccgcaatttcagtgcccagttcttgttcgattttataaaggttaaaccgatcattccagttaatcaaattgattgctaaacccaagtggccaaacctaccggatctaccaatacgatgtaaatatgtttctgccgttttggggaaatcgaaattgataacgacattaacggcttgaatatcgataccacgggtcaataaatcggagcagaccaatgtacgaaccttaccttgacgaaattcgtggaaaactttatttctttcttgttgcttcattcttgcatgagagtaataacaggaatagcctaaatcagtgattttcttggctagtaattcgacacggttagtagaattacaaaaaataatggcttgattaatttgaagcttagagaataaagtatttaaacaatgtagcttttgtctttcttcaacaaaggcgtagtattgagtaataccctttagagtcaattcttccatcaaattaatttcataaggcttatgcagatgtttaaccatgaattccttaaccgttagtgggaaagtagcgctaaataataaagattggtgagttggaggtaagaaggataagatttgttcaattattgtcttgaagtcacgagataacattttatcggcttcgtccatgatgaataatgaacaatcagacagatctgctacttttctcgaagctaaatccaacactctaccaggagtaccaaccaaaatatggactgtttcatttaatcttagaatatcgtctctcaaattggtaccaccagtggtcaccatacatgaaataccacagtgttttcccaatgtacggacgacttgggaagtttgcagagctaactctcttgtgggaaccatgatcaaagcctgaattttattcaactttggtttgactttctctaacgtaggaataacaaatgcggctgtcttacctgtaccattctttgctctggccaatatgtctctaccagttattgctaccggaatagcctcttcttgaataggggatggtttttcaaaaccggcttcaaaaatacccattaacagctctcttttcaaataaaaatcttcaaaagtattaccctttgtatttaagacatcatctgtctgtggtctggtatccttcttgggaatattcaatgcagttttccagtcccgatcgagatccgtattactgttattattagtgttgaagttattattgatggaacccattactactattttctttcttgtcgtattttaggcctgggataagttattatgcgaatggcgatgcggttatgaagaaataaaagggctaaaagtaagaattttctgcgtctatctttctattaggaataaaatatgactatatttactattattgttgttttgtcgtacaatcctttatgaatgaaaatattaagcttgtggtcttaaaagaatgtggatgaaacaaaactgaatccaatgatgagaaataaatgtacaatcagataataaacacttttattgatgattgtcttttcttgcaaaccccaatgttacaatcgcccattagttctaagattgtgttgtcctttttcttacgaaatttttttccctcccttttttgatcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtatcatcatcatcatctttgtccacgccatgcattatagatgcgtacagtaataatttcggattatcgccatcatccacgaattctactccctctacgattcagggattgtccaatattgcaacaccagttgaaaacgaacattcgatatcactaccacctttggaggaaagcctatcgccagccgcagcagatctgaaagatacgttgtcgggaacttcaaatggtaattatatacaactccaggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacctggttcaacgaattaacaatatcaaaaatagcgtatggcgtactaaatggcttggatcatttgtaccgacaatataagatcattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattgaatgcatgcgataacattagttaggaacatattgcactttttttcacatccctttctcaaagctatattcatatatatatagactctcctgattatgtaaatcacaaaccaattttctaatgtaacaatatttttaaaaataatcatcaaagtagcactttatgtacagaaaatttcacgattgagagaagcttgcgaataatactagttagcctgtgtttcaccatcgttacttaatttcttatagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttggcttcttttttaccatacttgaatggtttcccagatgccaagtatgagccaaatccaacagaaaacatagtgctcatgacttgacaaggaacgcaatccatagtctcttctttttccagctccctttgtggtggagggttgaacactgccaaaatattactcattgtttttcaccacttgctgtttctctctaagcggtgttttgtttcctacttggtggcacacaatgactgtactcgctttatatgctcgtaccttttttcaaaagcccatcgttaatttttcacccgaggaccccatattacgcgttttttgttaatgttcaatttctgacatgttacaattataataacgccaaaagaggtaaatgtatatttgaacaattgttaaagagaagataaaaaccctttaatcttgcatttgtcgtcaatagtacacaataggcgatctattttagtacggcaattaaaagaaagctgcttttcagtcaagaatgccggaattaacagaatttcagaaaaaacgtttagagaacatcaaaaggaataacgatttattgaaaaaactccatttgtctggagtagcatctcaaattaagcacgaggctggggtgttggaaaaatctagagctcctgcaaaaaagaaacaaaaaacaactaataccagagcaaccaagtctgcgagtcccactttacctacacgaagatcaagaaggctaaggggtgagtctgcagacgatgtgaaaggaatacccaatgtgaacgataatcagttgcttaaaatgggttctccagatggccaggataagaattttatagacgcaataaaggagaaacctgtaataggagatgtgaaattaagtgatctgatcaaggatgaagacgaaagtgcccttttagagaaattcaagaggtttaataacggaaacttttcttctggtgatttctttgaagaaataaaaaagagacagggtgacgttacggggatggacgaatttgatttggatctatatgacgtttttcaaccgaacgaaattaagattacatacgaaagaatctctgccacttacttccatcctgctatggaaaaaaagctaataattgcaggtgatacaagcggtactgtgggtttttggaacgttagagatgaaccactagctgacagcgaagaggaccgaatggaagaacccgatatcaccagagtgaaactatttaccaaaaacgtcggccgtattgattgcttccctgcggacacatcgaagatattgctcacctcttacgacggaagcatcaggtcagttcacttgaataacttacagagtgaagaggttctcaccttgaaaaatgaatatgacgattcactgggtatcagcgattgccagtttagctacgaaaacccaaatgttttattcctcaccacattaggtggtgaattcaccacgtttgacacaagagtaaaaaaatcagagtataatctgcgaagactcgcagacaagaagatcgggtctatggcaataaatcccatgagaccctacgagattgccaccggatcacttgatagaacactcaaaatctgggatacaagaaaccttgttaaaaagccagagtggtcacaatatgaagactatcccagtcatgaaattgtctccacatatgactcaagattgagcgtctctgcagtttcttactcaccgacagatggcaccttagtgtgcaatggctatgacgataccatccgcttattcgatgtcaagagtagggatcacctttctgcgaagttggagcccaaactaacgattcagcacaattgccaaacaggaagatggacaagcatcctcaaggccaggttcaagccgaacaagaatgtttttgcaatagctaacatgaagcgcgccatcgacatatacaacagcgaaggccagcaactggctcacctacccacagctactgtcccagctgtaattagttggcacccgctgcgaaactggattgcaggtggtaattctagcggcaaaatattcctctttactgatgactccggaaccataaagcaggaagaatgaaaacatctcagttacccgcactgccttttttctctcccgcttttcagcagaacgaggcgacaagcgaaggaacaaaacaaaacaaaagaaaacaaaaatattgaaatgcaagaacatggacacataaaaacatttttgatccggtcgaaagaaaacgatcagaaatttttagctgcttgcttagaagaaaagaaaagaaaattgcagagaaaaagctatttattgtttctgtccttcgctttaaaacatagagatattttgtcctttttatcattgcttattataaatgcatcataactcacagtctttgagctctggacacatcaggagccccgaggatgaaaatgtggcacctataggtaatcttaaacacaggactggatccctcagtcatatttcatctgcgcacccgagggtcgcacttagcgacgttaccaatatagttgcgacaaactctagcaacaacagcataagtaagccaaaagtcgccccaattaaagaaagattggattcagctgcgataattgaggaagaaaggctggatgcgaatagtgttgcacagagaaaagaagctgatcataacgatttgttaacggacagggaacaagaggaacccgttgaagacgacggagaaagcgaagaggatgaagaagaagaccaggagcctctactgttgcaacattatgctagtgatacattggtctgggagcatgcatttagaacttactatagaactacattagatcccaatgatgatgacgtgtacgatgtggtcatggttgccgaattatctaatgagatattcgagtatatgaggaaattggaagacctgtataaacccaacccgtactacatggataaacaaccagagttaagatggtcgtttcgaagcacactgattgattggatcgtccaagtacatgaaaaatttcaacttttacctgaaactctatatctctgcattaatataatagacagatatctgtgcaaagaagttgttcctgtaaataagttccaacttgtgggtgcagcctcactcttcattgctgctaaatatgaggaaatcaactgtcctacaatcaaggatttcgtatacatgtcagaaaactgctactcaaggaacgacctgctggacgcagaaagaactattttgaacggcttagaatttgaattgggttggcctggtccgatgtcatttttacgaagaatcagtaaggcagacgattacgagcatgatacgagaacactggccaaatatctattggaatccacaataatggaccatcgactggtttccgctcaacctagttggttagctgccggtgcatactttctaagtaagattattctgggccaaaatcagtggtctctggcgcacgtctactattccaattatacacaagaacaaattcttccgttggccaccattattttagaaaattgcagatatgcctctaaacgtcataacgccatatggagaaaatattcttcacgtcgttatttgcattcttcacagatcgtagcgaagtggatagcattagctgaacacagagtagaaagatctaactaaaaagcctcagctcgagacatggcatcaacaaaggaaaaaggattcattaccgtcttttgcacacaaaaactttaatcatcagtaataaacatatgtaactttttaaccttaaaacatactaatctccgtactttttttaaagcatccacaatccatatggatatgacgcgaaattagctcggcggttaattattaaaaaattgaagctaaaatcaaggttaacaaaacaactcattcaaaataacttactcattcatatactgccaccaaatggaatatgtcccatgaatggctcataagcgcatcggaaacaatgagaagcattggtaatggggaaggtttgcgggataaaggtgctgtcgttgccaacaatgacggagaatttaacgaaggtgatacaaatcgtgaagaggatagctctaccattttctccttcgattttgacgaggagattgtaatgtgtattgacttttctggaggaaaactcgggtgttctattttagattatcataccaagactttgaaagcgtttgaccaggactacgtggtcaataaaacaacaatttcgtctcatgatcttatcgatgatgcagatatgtcttcaaacgacataagtctgttacttggacttttaataatggaagcaaacccaactgtatgcctagtgccggcaagattggaggattggattttcgactacattaagacaaaatgcgatgagataaactgtaggctagaactacaaccaataaaacgtttcaaaaaatgggacttattgcagtcattgcagttaaggggtcatgataatcagactatattgaacgacatattatcaaatagcaaatttaccaccacagtcaccttaggtacagtgggatgcatccttgcaaatcatgaacaacttggtgaatacaatgacagtactgcttcaagtaatatggtaacaggacgattagttcagaatgcttttgaagatgtgatacatggcataaggtatatcgacataagggatcggatggtactggatgaaaatactatatcggctttgcatatttttccaacagctcataaactgggccatgataagatgatgagaaatggtttctttagtgtatttgaactattcaatcaagtgtcttcggactacgccaggagaattttgaagtcttggcttattaacccattaaccaataaaaaacggatagaaacaagatacagcatcataagaaccttattggataaacaaaacgccatcatttttagtgaccttagccaatcaataaaaagatgtccagacgcttttgggtttataaatcagttaagaagtggtaaatcgacattagggacatggtccaaggttgcaagttttttagaaaaaggaatagctatatttcaactggtgtcgtccttgaaattaggttcagacgaagccaacattttacatgatatcaaaaataaggttgatatatcagctttaaaggaatgtttgagaaaagtagaaacggtaatagattttgacacatcaagagataccaagacgctcacgataaatacgggggttgacaacagattagacgaatgcagaaatatttataatcatttggaagggatcttactggatgtcgcaagagaaactcaaatttttttactgaatactatgcctcaagaagattgtaagacaacaaagagtttagaaaagttagtgaatgctgtttatattccccaattaggatacttagtaaccattagcgtcttaatggaacctttattggatggcattccaaaccttcaatgggaagagatctttaggagttcagaaaatatatacttcaaaaatggcagggttcttgagctggatgaaacatacggcgatatttatggcgcgatttcagattttgaaattgaaatcctgttttccttacaagaacaaattctgagaagaaagactcaactcactgcttacaatatactgcttagtgaactggaaatattattatcgttcgctcaagtgtctgctgaaaggaattatgcagagcctcaattggtggaagatgagtgcatattggaaattattaacggaagacatgctttgtatgaaacattccttgataattatatccccaatagcacaatgattgatggcgggctattttctgaattaagttggtgtgaacaaaataaaggaagaatcattgtagtcactggcgctaatgcatctggaaagtctgtatatcttacacagaatggtttaattgtgtacttggcacaaattggttgttttgttccagcagagagagcgagaattggaatagcggataaaatattaactagaatcaggactcaagaaactgtttataagactcaaagttcctttttgctagattctcaacaaatggcaaaatcactgagtttggccactgaaaaaagtctcattttaattgatgaatacggcaaaggtactgatattttagatggaccttcactatttggttccataatgctcaatatgtccaagagtgaaaaatgtccacgcataatcgcatgtacacactttcatgaactatttaacgaaaatgtactcacagagaatataaaaggtatcaaacattactgcactgatatacttatcagccaaaaatataatcttttagaaacagcacatgtcggagaagatcatgaaagtgagggaatcacattcctattcaaagtaaaggaggggatctcaaagcagtcatttggcatatattgcgcaaaagtatgtggtttgagcagagatattgtggaaagggctgaagaactatctcgcatgattaatagaggcgatgacgtagttcagcaatgtggaaatctgaccgaaaaggagatgagagaattccaaaagaatcaggaaatagtgaaaaagtttttatcttgggatttggatctcgaaactacaacaacttccgagaatctcaggcttaaattgaaaaatttccttcgctaatatatcaaagaataaaaaaacgcttacttgtaacatatttaagttaataaatgtcaagcggttgctcttttcttataaaaatatattgtatgggtacaaaaattttgacaccactacttgggtaaatactacatatgtaaatttttttaattcttgaatttaacagacctcgtcaaacccttcttgatacctgtcttttcaccttcatagacgccagattgaccaccagaataaactgcacgaaccgacttgagtttcttttgtgccttttggtatttctttctcttcttgacacgagagtttctgttatccttgtttcttttaggcgttagacccttgttctttaaaatttgataattaatggcacgcttaccatcacctgagacattttcagccaattccgccaattttccttcccttgcagcaataacagcattcttatgagcctctttacgagatattttcttgtcttgtttacctctctgaacctgttgataataatcgttctcgccttgagtgttgatgctcctagacacagcttcatcttcagaaccgtaatccttatcgtctaggtcagcaccattattatcatgcataccacgtttacgagcttcatccaacagacgttgctgcctttcaaataaacgttccttatatggaatatcatcatcacctttgaatctatccgtctttttattttcttgttgatcaattttcgaagtatagaaacgcaaagttcttctacgagcttttttgtcttgtgcgtccacatcagcaatctcagattcaatgaaatcatcagcttcaggcattgatgatgttttcggtttagaatgcagacgtgattgtgctacgtactcttcaaaatcgtcaatatcaacatcttcttcttcttcttcttcatcgctttctctttcttcttcatcaatttcttgcttttgttttcctccatcctctgcatcagaatcttcactgttttgcaactcattcagcttcttttcgttaaaggcctcaatgtttgcggtttcttcactttcagaaccatctccttcattcacatcaaaactagatggcaattcgctggcttgcctccaaatctcttttgtcgttaaaatcttttccatgaccggatgtcccttcatagatgtgaaatcttcattattatggagttcgtgcaacaagatactatagtaacatgatattgtgcctaggtaacttccaagtgcaattagctttaatttattgaactcattttcctcagatttctttaattcgtcaaactttggagctaattctgtgaattcttttgaaagtggagcaaattcaggaaacattgtccttaaatagttatcccttgcttcgtcatccatatttagaatatccgttatggaagttttagtatcagcctgcttggtcgagttcttaaattcacccatgtcaaattctttggcacttttgacccactcttcttcttcttcttcatctaagtaatcgttcatattaagttcttccagatgcttcttttgttgtcgtaaagcttccttttctatttccttagcagcttcgtcatcatctaaatcatcagccccataatattctccttttgtggacccccaggcattctcgttgtctaacataccattctcttcatcttcctcaggaagctggtcagtttctaagtttctaccaaatattttcttataggctgcagcaccatctagttcctcttcctcttcttcttcctcatcttctctttcatctattgactcatcatcttcatccatggctaagacttcttcctcatcttcgtcttctaacagagaatggtcatcatctttattactgtcgccaaaggtggattgtccaagtaaaaccttttcccttttagaagcaaaatcatcaacttcgtttaaaccatacggattaatctcatccccaacttcagaggtcttagttctgtttgagcctttgcgtaccatattattctatacacccactctaatatgttttctcttcctccaaaactttttgtataaaagcatcagtgagatgagctatgatgagatgagcttcattattgaattttttttcattgcagaagcgcagtttgaaaatttttcatccgccctgcaaagtccaattttttgatcagcagaagataatgaccagagaattatggtattcaagagaacaattcaaaagaggacagctagaaagatattgaggtatttataatttgctagactaaccgaaagtcgaagcgtaatcttgttttttattaagcgggatagcattcattaagtatgagcagtaataaaggaaatgggcgcttgccatcattaaaagattcctcctccaatggaggaggatctgccaagccctcattaaagtttaaaccaaaagcagttgcaagaaagtccaaggaagaaagagaagcagctgcgtccaaagtaaagctagaggaggaatctaagagaggtaatgacaagaaacatttcaataacaagaataaaagagtaaccggcgctggcggccagcaaaggcgaatggccaaatacttaaataacacacacgttatctctagcggtccattggcggctgggaactttgtaagtgagaagggtgatttgagaagaggattcatcaaatcagaaggaagcgggtcatctcttgtgcaaaagggcctggaaactattgacaatggtgctgagagctctgagaatgaggcagaagacgatgataatgaaggtgtagcgtccaaatctaagaagaagttcaatatgggaaaagaattcgaggcacgcaatctcatagaggacgaagatgacggcgaaagtgaaaagagcagtgacgtcgacatggatgacgaagaatggagatctaaacggattgaacagttattccctgtgagacctgtccgcgtaagacacgaagacgttgaaactgtcaaaagagaaatacaagaagctctttcagaaaagccaactcgtgaaccaacccccagtgtgaagacagagcctgtcggaaccggattacaatcttatttggaagaaagagaaaggcaagtcaatgagaaactggcagatcttggacttgaaaaggagtttcaatcggttgatgggaaagaagcggccgctgagttggaattattaaatgcagatcatcagcatatattacgaaaactaaagaaaatgaataataaaccagaaagattcatggtattccagttacctactaggttaccagcttttgaaagacccgctgtgaaagaagaaaaagaagacatggaaacccaggctagcgacccttcaaagaagaagaagaatattaaaaagaaggacacgaaggatgctttgtctactagagaacttgccggcaaggttgggtctatacgggttcacaaatctggaaaactttccgtgaaaattggaaatgtggtgatggatattggcaaaggtgccgaaaccacatttttacaagatgttatagcattaagtatcgctgatgatgcatcctcagcggaacttctaggccgtgtggacggtaaaatagtagtcacacctcaaatctaatcgcactcgcatctgtcgagtatataaatgaatatacacagtcataaatacttctagaacaaattacactaattaagatgcttagattcccattcaaaaggtactattgacgtcttgtcttctacaatttctcatcctctttgaacattggtaatgttattctagttattgttacccagtttcggaactttaggggagccacactttaaacaaaaagaagcgccataaccaccgtgaagtaatgagtatctcactttgataagaagacatttaagaacagcctgaaatatcaaaatcacggaattattaggttatggagagagatgaataccagttacccaactctcatgggaagaatactttcttatcgcgaatatttggtttacaatcggatgaagttaatccttctcttaatagccaggagatgagcaacttccctttaccagacatagagagaggctcatctttattgcattctactaacgacagccgcgaagatgtagatgagaatgacttacgtgttcctgagtctgaccaaggcactagtacagaagaagaggatgaagtagatgaagagcaagtccaggcgtatgctccacagattagtgatggattggatggagaccaccagctaaattctgtaacgagcaaagaaaatgtacttgaaacggaaaaaagcaatttagaaagactggttgaaggctctaccgatgattctgtgcccaaagtcggacagctttcgtcagaagaagaagaggataatgagttcataaataatgatggatttgatgacgatacgcccctttttcaaaaaagcaagattcatgaatttagctctaagaaaagcaatactatagaggacggtaaacgacctttgtttttcaggcatatcttacagaataaccgccctcaacgtgatacccaaaagctatttacttcgtcgaacgccattcaccatgataaggacaagagtgcaaataatggtccccgtaacattaatggtaatcaaaagcatggcactaaatactttggtagtgctacacaacctcggtttaccggttcgcccttaaataatacaaacaggttcactaaattgtttccattaagaaagccaaatttactgagcaatatatccgttttaaacaataccccggaagatagaatcaatacgttgagcgtgaaagagcgggctctgtggaaatgggcaaacgtagaaaacctcgatatatttcttcaagatgtttacaattattatctgggaaatgggttctattgcatcatactggaaaaaatattgaatatatgcactttgctttttgttgtttttgtttctacatatatgggtcactgtgttgactactccaaattaccgactagtcaccgggtttcggatattattatcgacaagtgttattctaatagtataacggggttcacaaagtttttcctttggatgttttatttcttcgtgattctcaaaattgttcaactctactttgatgttcaaaaattatcagaattacaaaacttttacaagtatcttttaaatatatcggatgacgaacttcaaactttgccctggcaaaatgtgatacagcagctaatgtacttgaaggatcaaaacgctatgacggcaaatgttgtggaagtcaaagccaagaatagaatcgacgcgcatgacgttgccaatagaatcatgagaagagaaaactatctcatagcactttacaatagcgacatcctgaatttatccttgcctattccattatttaggaccaacgttctgacaaaaacactagaatggaatattaatttatgcgtcatgggctttgtgttcaacgagtccggatttattaaacaaagtattttaaaaccttctcaaagagaattcacgagagaagaattacaaaaaagattcatgctggcaggatttcttaatattatattggcaccatttctggtcacatactttgttttgctttattttttcagatattttaatgagtataaaacttctcctggatctattggtgctcgtcaatacacaccaattgctgaatggaaattccgtgagtacaatgaactttaccatatttttaagaaaagaataagtttgagcacaaccttagctaacaagtatgttgatcagttcccgaaggaaaagaccaatttgtttctgaaatttgtttcctttatttgtggatcatttgtggccattttagcttttctcactgtattcgatccagaaaactttttaaactttgaaatcacctcggacagatctgtcattttctacattactattctgggtgctatatggtctgtaagtagaaatacaataacccaggagtaccatgttttcgaccccgaagagacgctcaaggagttgtatgaatatacacactatctaccaaaggaatgggaaggaagatatcacaaagaggaaatcaaactagagttctgtaaattgtacaacttgagaatagtaatacttttgagggaactcactagcctgatgataacaccgtttgtactttggttttcgttgccctcgtcagccggcaggattgtagatttcttcagagagaattctgaatatgtggacggattaggttacgtttgcaagtatgctatgtttaacatgaaaaacatagacggtgaagatacacacagcatggatgaagacagtttaacgaaaaagattgccgtgaacggaagtcatacactcaacagtaaacgaaggagtaaatttaccgccgaagaccatagcgataaagatttggcaaataataaaatgttacaatcatatgtatattttatggatgattattccaacagtgaaaacttaacagggaagtaccaattgcctgcaaaaaaaggctatccgaataatgaaggcgattcatttctcaacaataagtattcttggagaaagcaatttcagccaggtcaaaagccggagctatttagaataggtaagcatgctctcggccctggccataatatttcccctgctatatattctacaaggaatcccggcaagaactgggataacaataataatggtgatgacattaagaacgggaccaataatgctacagctaaaaatgatgacaataatggcaataatgatcatgaatacgtactaacagagtctttccttgattcgggcgcattccctaatcatgatgtaatagaccataataaaatgctaaactcaaattacaatggtaatggcatactcaataagggtggtgtcttaggacttgttaaagagtattacaagaagtctgacgtcggaagataaggcagactgtgtcgtgtacatcatccaatataactatatatataactgtttcctttctttttcgtatttacctaaatgcatatattattcagttcccactaattttgtactacaataataagagaatcccttccctgttttagaaatgagtagttcttttctttttcataaataatacagttgtctctgagaagcctaataagaaaaaaagaggttaataaattattattattggttatttctttccgccacgtagttttctttctctttcatacttgtttttttccgcaccttcttcggtattaatagtgttaacaatatgagccatctttgcatggtagtcgctgctctccttgttcttttcttcaattctttgtctagcttcaaatttggcgtctttacggatttctttcatagtgaatttacgttccttctttagttgggccttcatcttatttatctcacttcttgttctatcaggatcgtacgattttttatcaggattgaagttttcttcgtatttaggagcatgcgtaggtatggatacgggtttgtggttctgtaaagccaacggaatatgttctgtgaatttcgttaatttttcaactttgttcaaaatatttcttggcttttcaaaatcagaatactttgaggtgtatgcacttaataactgctgaatcggtaaaataatttcattgaaagcaggtaagctcttccacacagtagagatagttgcatctaaagattccataacatttagtaaaacggagacacattgatcaaccggatgtgcctcggtatccattgttgacaaggtatgtaatggaataatagttgatctcttttttgtaaagtcaacgtccaatggaagccccaactcgtaagagtctagtctaatattttcaaaatctaatggtttttcttgattttctttctcaactataaaagtgagtaatattttttgaaagaagtaaaccacctccggtatgtaccgtttggaaatgcgttgatattgtgaaacaatccttaccaagacagcgccaaaagctatcctctttaaagaattaaacttgatttgttccaggaactggctcattaaaatcaatgctggagttattactaaatggtactggtccgaggtggagaaaagaataccaataatggaaaaaaataccagatcaccatttgatagagcatcaaaatggttctttttatagcgtgcttgcatttcattgatataatctctacactcctcggaaagctctctattatatttctctgaaagggattttagaattgagatcaatgcattttgtgtacgtttaaaactttgaacgtttttaaggtagttttgattgcttagaaaaatgatgtgtctcagtaaaacagcggtgaattttcctaacttttccttattaccttcagccaattttggttggtaagctttgataatattcttaacaatcttaggatgatcatctaagtctaatttttttacttgatctaataacgcatcatgagttctagggcatgaaatggaaatgttctttttctttaaaatttgagaaaacccttcatctctgccttgatcttcaaatttgatatcatcatcagaatcagcaataccgtcattatcgtcttcatagtcttcttcattttcccagaatccatcatccaaatcctctactcctctttcttcgccttcttctaattcaatcataccgttcatacgatcaagacgctgttgttccaactcccgttttttttcttcagcttcagcgtttttctcctcttcagttttagttctatcagagggtgcagctcttttgtccaattgtagttctttcactttgatatcatactccttatctagatcggtcttaggttccattggattcttcttgggttgcgtcatcatcaattcagacataacatcctcgaaattatcatccagattatctatttgatcttccattataccttgagccttttgtctttcttgtttgtaaaattttgatttggcaatgacctctttcatgacttcagctttggttttttttctttgaggttgctgtagctcagcatcatcttcattgaatcgtttggaagctaaaaaatcctcttcatcattggcaagctcatcttctagggacagcgattgacctaaatgtgtaagaccgtctccaaacatgtcaccgtcgtcttcatcgtcttcaagattgaataaatttgcgtttctctttgattggctttgtctttctctggtgaaacgttccaacattttttcttcttccgtcaacaacttgtctctttcaccaaatctcttatcgatcacaccaccacgtttattcttcatcatttttcttgcttcaaatgcacgctttctttgttcttcaccgatctgtttagagataccaggcttacccacagcaatacgatcagcagttttagaaggcagaccatctctcctcttattccttgcagcctttatttcaaacggattaaactcttctctgatttcagcaatggccttttttttttcttcacgatcatactccttcgcttgtcttttggaattctttttattcttacttttgacgtttgtttgacctgtgagtccacgggccttcaaggcggcctttaaattcttaagttgtgaaccggccatgtatttgatcttcccttttatttgcttctcaactgtactatttacagtaataattagtgcaaccttcagatgcttctcgctaaatgctcatctctaaattatcattattattcctaataaatcctaaaatttttcactcgttctgtacggctcatcgccccaatattacccgtcttgtatgtgatctttttgacttttcggtggcaaaatgcaaaggggaatccaaggaaaaaccataacaggacactacatcagagataatcttgaattaagagagtagaggaatatactgctgggctcactaccatttttgttgctagagtaaacgtagagaaagatgtcaagagatgcaccaattaaggctgacaaggattatagccaaattttgaaggaagagtttcctaagatcgattcgctcgctcaaaatgattgtaactctgctttagaccaactgttagtgttggagaagaaaaccagacaagcttcagatctggcctcctcgaaagaagttttggccaagattgtagatctgctagcatcaaggaataagtgggacgacctaaatgagcaattgactctactctcaaaaaagcatggtcagttgaaattgtcaattcagtatatgatacaaaaggttatggaatatttgaaaagctcgaaatctttggatttaaacaccagaattagtgtcattgaaactatcagggtggttacagagaacaaaatatttgtagaagtggaaagagctagggtcaccaaagatttggtggaaattaagaaagaagagggtaagattgatgaagctgcagacatcttgtgtgagttacaggttgagacctatggctccatggaaatgtctgagaaaattcagtttatattagagcaaatggaattgagtatattaaaaggtgattattcccaagccacggtgctttcaagaaaaattctgaaaaaaacttttaaaaatccaaaatacgagtcattgaagctagaatattataatcttctggtaaaaattagtttgcacaagagagaatacctagaagttgcgcagtatctgcaagaaatttatcaaacagacgccattaaatcagatgaggctaagtggaaacctgttttatcgcacattgtatatttcttagtcctttcaccttacggcaatttacaaaatgatttaattcacaaaatccagaatgataacaacctgaaaaaattagaaagccaagaatctttagtaaaattgtttactacgaatgagttgatgagatggccaattgttcaaaaaacctatgagcccgtcttaaatgaggatgatttggcatttggtggagaagctaataagcatcactgggaagatttacaaaaaagggtcatcgagcacaatttaagagtcatttccgaatactattccagaattactttactaagattgaatgaattgctggacctaacggagagccagacggaaacatacatcagtgatttggtaaaccagggcatcatatacgctaaagttaatcgcccagccaaaatcgtgaattttgaaaaaccaaaaaactcaagccaattattgaacgaatggtcacataatgttgacgaactattagaacatatagaaacaataggccatttaattacaaaagaggaaatcatgcacggtttgcaagctaaatgaagagattttcgagtaagtgtcggattatctcagatccggttttgattttaaatctgttactaatcgaaatgtgtatttacgtacgtgagataaaattatctatgcatatatataactcaaatggaaaatggccacgtattgctctcattctcttcacttgcttacacaaaacataaggtgacaattaatggaattttagtttttcaatttttcaggggaaagaagacacccaaaaaaaaagtgaaaagtcaaaacggtaaactgtttatggtatttaaatgacattaatagcagcgtaaagagtcattttttcgtttgattagcaaaactctgaacattaattactacacctatagacatatctttaaacagtgaaatatttttttcatttagtaaacaagaattaaactttgaatatttttttttcgattaacttatgtcactttagcctatactttcttcgaacatttttcctttcattttgactcatgatattagatccattatctccaaatattgaaaatcatactcaagatgaaataattgagttttgggaaaaaactgagtctattgctaacataccaaaggaaaacttggatgaatcccatgttaactcaagcctggttgcctacctgaagtttgctactgattcctataaggtttttattaatactgatcgtgacctctaccggatgtcgctaatactgttagaatcgtccttatttgaatttaaaaaagagttttgcctaagtaagttgcagtcgttactcaacatagacctactggaaatgaatatgaagttcattattgtttacattcttctctgtgaggcgaaaaaaaacgtgtactccttagaaatcatgctcaagttccaaggatttactgtgttttataataccttgtacacacaattcgcctatttgagcaaatacggaaaggaaaggacagttgcttctaaacatcaatacaattctaataattctagcacaggtacatccttggacagtttagaccgaagtttgactgatattgatttgggtattatagacgaaatgaagcaaatttcaactgttttgatggatttgttatttcaaattatgaagtactgtaagtgtgttattgctaatcttcaaattgtggatgacttttttgtttactatatgatggaatcaatgaggtccgacactatggacgatatgttcaataacgcggagtttaaactgctgttggcgttgaacgaacaatatatgatgtttgccaaggagtacgacattgagaacaaggtctataagtatttgatcaatgggtctgtctcaagatgttttacggagctattattactgaaattcaatagggcatcggaccctccgttacaaattatgatgtgcaaaattatttatcttatcttgacaccaagaggagactactctccgatgaatttcttttatacaaacgacttacgtgttcttatcgatgtattaatcagagaactacagaatatcagtgaggatgaagaggtattgagaaacacccttctaagggttctgattccgctattaaagaatacacaattatccaaaacacattatagaaaggatgatttgaataaactattaaactacttgtcgactttagataatatatgcgttgacagtccagcgttgcacgagcatcaagttacagtggccttatctcggaagtgtcttcaacaaattccttggttagagacaccttcaacgccttcagatggaggttcatcggtctctagtaataacactagtagaaactctagcattgttgcattggggacgcccgacaatcaaaatatcttggctcgtaaaggccatctttatagtaatcgtgaattagatgtttctgcagaatctttgactaaaagaaaggctaaagctccgcctccgcctcctcctcctcctccatcaagaaaatgtggaactccaaaataagtaaagcattatttcttcttgcattaatgtggttcttccgaccatttcttcttctactcactgcagtatctaatgacacattgtactttttatatacaaatgcaacaatcgtaactataaaactaaagttcgggttgcttccgaatacatgctggcagaatttcaggttgtgtgtcacttgttaaaataggcgatattttttattttagaagttgtatataactgttaattacatagtcagtttttttttttcactatcatattgtttagattaaaaggacttgtcacatgaaatttaggtcgagcagaatacaatcccgagaaaatcaataggcaaaatagcatttatacacgtattcttaatccggatgcaggtgcaccgatcttagaaatcatagcaattctatctattttatctttttccgtgataacgtatttactacctgttaatgggtcagaaacggaaggtgtatcttcataaattggtttgtaggtggctgcacaaatatcgaatttagcataaggatcaaagtcaattggaatggcgtcactggccattgagtcggctttgtttttgattttacgtgcttgttctgcacgaggaccagaagaaataatctttaaaaattcaccggcaaaatatgaggcctgtaagaaatttttgtgtttgaaatgttgggacatagccacttgtaaagcattggtacgatgaattggggatagttttgcctttgtaaagtatgcagctagctcaagcatgcgtacagtatttccctcctttaatgagcggcgttccaattcaatggataaacctaatatatactccctagcagtttccagtatcttgtgtgctaatttttcatcttcagcatcatcgaccattaatagcgtaatacggtagatagcttctctgaagcattcgattgcaatatctggtttgtttagtttaaagtttttgtaaccctcattcattttttcattaacgacatcaagacctggcacgtaaggaagaatttgatcttcacttacggtatcatcatacgctctgacataacctaattgagcaggaagttcacagggcgtactaggaatgtatgttctacaaccctcataaatgttggtaaaatatttcttcaatggctccagcttgactacacccacttgcttgctcaaggcttgaacagcggcatcaaaggcaccagcggcaactaggacagcaggcagtttagaattcttgatccaaatggctgtttcaacttcctgtgctggagaggtaatttcgccttgctcaacttcttcaggtaactcttctcccacatccaaatcttcgtcacccaaatcccaggcaccttcgtcttcaccaatatcctcatcgttaaagttttcttcgcctagtggttcttcttgctcttgagtggtgtttactgctggagtttcatcgtctatagtcaaatcgtcaatttgacctaaaacagccttttcaaagtaagatagttcagcctcttttaatggccatttttcaagtggctttgagatcactggtctttgaacgaagttggaggcatccatctggtctggtaaagtaacatcttgttcatcaacttcagcttgctccaagaaagcagaagcagccgcttcatctccgttagcctttgctacggcataagctaatggtaaagagccgccctctgcaaaaatgctagatctttccttggttgaattgttgtaaaaggtgtttaatagcatacttccaaagtcttcacgagtctgagcgatattttgcattttagatagtttgttaacgtcacctgtaactaaatacaggaaggaaagtttgtcaaaagaatgttgagtttgataaatcatttcagctaagctggcattaccttgtgccaaggcttcttggattaatctttcccaagtactagaatcattcagttttttggcttcatctaaggcaacatccaaattaccgtattccaaagctaaatcaaaacggatatgtgggtcttgaacgaattgtaaagcaatttctgggtaacctgacttctgcagataggaaatgatattctggccaaccaaattagaatcttttatcagacgtaaaacttctgggaaatttttgttaaccagggcctttttgaagcgatattctgtaggatcaatggttaaaatttcaatctcaccttcacggttcaagcagtacactaattttccctgaacttttgtgatatataaagttttctccaaagttttaataatacctctatccccgttcaatagtgagtaccttatatgatttaaagttgaataaattaatacaccagtttcatcccaagcggcacttttgattctaatcgtttcatgcatagaattaatcaattctagctttttggtagccaaagttatggtgtgcttactcatcaatgcaacatattgaccatctaaggaccacgaaacgtacttgacgtttttaacagccaattgggatacttttttgccctgttggacatcataaagaataacttctctggggtgtatgaccaaaacagatccaggacctgcagctacaatagttcttactgtttcctctactttgatatttcttgtaactttgttttcgagagagcgaacttcaacagattcagtgttcttgttgtaaacaacaaatctattacgaccaacaaaagtagcaaaattacctgtatcttgggtgacacttgttggctccacagctccaactggttgttttggtaaaataacgagagcaaatttgccattagcttcattaaccaaaactgaatgttgggagggattgtacgatatacttctgaatgcatcccaaggttgaccaataccctttaaggacgcataaggtaatgaagcgactcttttctggaaattgaaactttggatttgcttttccgcattgacaaaaaacaactggttttgatggataaagctgcatggtctttcgcgatcgagcttgaaaaccataataccagaatcgtgagctgcaccaaatagattgatatgaggatgtgctgcaatcaaccaaaatctatcgttttctcttttgaattgctttactggagttctcttgtcaagatcccaaacccttagcgttttgtcttcaccgacagaaatgatcaagttttgatgtgggtgaaagataacactatcaacattgttagtgtgacctctgcaagtatcaacttcccaagctttcgtagcactcattctccataatttaacttgacggtcgtcactgccggagacaatcaatggtaaagttggatggaaagaggcccagttgacacctcttgtgtgaccctctagaataaacttgacaacacagtcaccaagagagccatccaatagattttgttgtgcactcatttgctcctcaaatgaactagtaccaggagcggagtgtcttttccttaaaccggaaatatcccaaattctgatggtttcatccagagaagcggaaacgatcaggtcatcggttggatgaaattgagcacacatgacaaaatgattgtggccggtcaaacatgcaatttccttacggttttgccagttccagattcttatggtctggtcatcagaagcagatatgatccaaggcagctcacggtggaaaaacacggtacggacataatccaaatgcccagttaaggtgtatagacatttgttagtatctaaggaccaaactttaatggtatagtcgtcacctgccgaaacaaaaatcggttgggttggatggaaatctagcccacgaacagggccctcgtggtcttcaaatctgtgaagtagtgttcccatcctgtaatcccataattgaatagtagaggaaaacaaagccaccaaaacccaaggtctggaggggtggaaggcaatgcccttggccctagtggactttgattcaaatttagttaacatcttcatcttgatccagtaatgaaatgaacaaagacactacagaagaaaaaaagtatactgatttcaggttaaataaaccgcgaatttgtaaacaggtatgataatgtttttattcaaaagtgtaaagggaagataaaataaaaagaaaaaactttatatcttaagcaaagaagggggtaagtaacaaatgtttggaaaatcctgctggtttcgccaattctatgatttacctaattgcaatgcctcttcaaacaagtttgtggtccctgtatgctactgaatcgaggctcaatcgtcacagtctcgaagacggatctgttatttattcaagttggcaaattgtcgatttcgtttcgtgttgtcgaaattttcggtcgctctgtacgtcgtataaatgctgacaataagaataatagttaagagtacatactaaattatgtgttacaatatactagatgaaggctcgtcaacgaggcaagcaatggttggaactactcgtccacaagagtggcagttttttcgtcgaacttcaataggcctttccgctcctttagtttggcctgtactagcacaagtaggttgtataagatagaaagagtgggtgtagcgacgccgtttcttttcgcgattcttatggggttgcctaggatgacttctagctccatcaattggcccttctcgcagtccacgcacatggatggcttgaacacctttttcctggtaatctctgtaaacatcgttatgaactcctcttcgataatgatgccttcactcgccgcaatggcgatgatctccctcatggcagggtggaacacttcaatttctgtgctcttcttgttaaccccaaactccaggcaacgcggaacgtctagccccacaagtgccgtggatgtgttgatagctgcattgtagagcaacttcttccaccgagagtaacggaccctagggtcaaattcgacaaagttttgcccctcgttgctgtacatcctgacgaagtcgttggcagcctggatagcagcagcgtcctgtggatcaaaagctccacacgataagtggtcctggcccacttgactgatatggcctgacccgatcttagtggatccgattaactggatgccagaaagcaccgtgtaacgatactgctctctgggaaattccgcccatatctccttctcaatatcgattccgttctgtaccagtaaaatgtgtgtcgtcaattgcggcccatgtagctctttattcttctcaagcacaggtctgatgatgttggacacccttgaattaacgggcccatctatgatgttcttggtagtcactacaatatagttgtatccttggttgtctgcggcagaagcagcgtcctcgacgctgctgtaaatatggtggggtctccaaccttctaaccggccatagtcacatgattcgattgtgtagccatgcttcaataccctatcgtagtcagatctgactaccaaggaaacgtcgctctccttcttaagccacaacgaaagcgcagtaatgaccccaacgccacctgccccgataactagtattctagacattttcgacattagcttatgccaacttgtatcctggcaccgggactgtagtttatgaggtatatcaatatgtcctaattaaggctatataatttggtattactatcacttgccacggggaaactgaaatttttttcgtttcgccaccaagaaaggctaattgaatacagttcaagaggttgatatagctaagtgggcatgaaggttatgaattgtaattggaggtgcggcaagtgtgcaagacgggtaaaggagagtatagaacgatgtctgctaaagttccatctaacgccacgtttaagaacaaggaaaaacctcaagaggttcgcaaagccaacatcatcgctgcacgttctgttgcagatgccatccgtacttcattgggtcccaagggtatggacaagatgattaagacatctcgtggagaaatcatcatctctaatgatggccacaccattctaaaacagatggccattctgcatccggtggccagaatgctagtagaggtttctgccgcgcaggactcggaagccggtgatggtaccacttctgtggtgatcttgaccggagctctattgggtgctgctgagaggctgttaaacaagggcatccatccaaccatcattgcggactcctttcaaagtgctgcgaagagatctgtcgatattcttttagaaatgtgccataaggtttcgttgagcgatagagaacagctggttcgtgctgcatccacttctttgagttccaagattgtgtctcaatactcttcgtttttggcgcccttggcagtggactccgtattgaagatatctgatgaaaactctaagaatgttgacctgaacgatatcagactggtcaaaaaagttggtggtaccattgatgacacagaaatgatagatggtgtggtcttgacacaaacggcaatcaaatctgctggtggtccgacaagaaaggaaaaagcaaagattgggttaattcaattccaaatatctcctccaaagcccgacacagaaaataatatcatcgttaatgactatagacaaatggataagatccttaaagaagaaagagcgtatttgctaaatatctgtaaaaaaattaaaaaggccaagtgtaacgtgctgttgattcagaaatccatcttgagagatgcggtaaatgatttggctcttcatttcttgtcaaaattgaacataatggtggtaaaggatatcgagagagaagaaatcgagtttctgtcgaagggcttgggttgtaagccaattgctgatatagaattgttcaccgaagatagattgggttccgctgatttagttgaggagatcgatagcgatggttccaagatagttagagtaactggtataagaaacaataatgcaagaccaaccgtctctgttgttattcgtggtgcaaacaacatgatcattgatgaaacagagcgttccctccatgatgcactatgtgttattcgttgtctagtgaaagagagaggtttaatcgctggtggtggtgctccagaaattgaaatatcccgtaggttgagtaaggaagcaaggtctatggaaggtgtacaggcttttatttggcaagaatttgcctctgctttggaagttattccaacgactttggctgaaaacgcaggtttgaatagtatcaaagttgtcacagaattgcgctctaagcatgaaaatggtgaattgaatgacggtatctctgttagacgatctggtactacgaacacctatgaagaacacatcttacaacccgtacttgttagtacaagtgcaattaccttagcgtctgaatgtgttaaatccatcttacgtattgatgatattgcattcagccgttaacatgggtttcccagtatccatatgtttatgcatatatacatatatatgttgatttagtgtattttccactacataaaaactaaaaaacattcaaaatgaaaagtcaggacccttttcaaaaaggatcgcaattatactattttaaaagtttaaaagcgtttctctttaatgcgtaggatactccgctcattattgtggtcgtggcggttacataccctaaatagctaaaggccttttgaaagtcctgttttctatcttcgaaatcctcctcggttttttcacagccctcttctttctcatataaaagtaataatactccagatccaagatataccatttggaaaaacgtgttccattttgatagttgggaaggtctgacctcagcgctgggatagcgaacaatatcccaataggaattccatgccacacgaccaggatatttcaactttaaagtgctatatcgtataaacaaagcacttatggctagtagcacatctctacccagaattatcgccgcaatagataccggtataatctgagggccggatggtacagataatgccaaagttgttgtgatcatgagtagtttatctgcaagtggatctaatatggttcctgcaatggttttcaggccgtattttcttgctatatacccatccataaaatcagtgatgctggaaaatgcaaacaaacctaatgctggggtcaaattattcgttataatgaagagtccgataaagggtgtacatcctattcgtgataaagtcaaaatgttgggaatattgagcaacttgctctttatatgaggagttttactcggattggtagcatattccctcctagtgagatctctgaaaagattgtaatttaattgcgggtttaccttaaagcgtacagttaaccctgataacacatgatagaatggccttttcggtatagttctccgaagtaatgcggagcatgaataaatgggcaccatttgaatcattgactaaattattagggaccaaactatgctaccaggcctgcttgtttctcaattgcctcctttctatattttttcaattgtaaatattgtatactcccgattaagaggatggcttcatgaatcgagctttttcacactccagtttcggaaatagtcgccgcacaatgattcgaagacatgactgtgaagtgttggttgacatttaatatggtttcatgtaagagatcccagagctacggacttggctttttcttcctgtaattgtttgccaaacgttgggtaaacgcacatataagtatattttactttccttctcccttcgtcagtttttcttttgctgtaatatattgttctcaaaagttgtttggtatacaaaagtgcaaggtttttactggttgttacaggttcagagttccaataaagaagatattagaacgatcttatcaatattatccaatttcaactaatatgaatgtattagtctataatggcccagggactacgccaggatcagttaagcatgctgttgaaagtttacgtgactttttggaaccctattacgccgtcagtactgtcaatgttaaggtattacagacagaaccatggatgtcaaagacctccgctgtagtttttcctggtggtgccgatcttccttacgttcaagcttgtcaacccattatttctcgattgaaacattttgttagcaaacaaggtggtgtctttatcggattttgtgcaggaggttactttggcaccagccgtgtagaatttgctcaaggtgaccctacaatggaagtatcaggaagcagggatttgcgattctttccgggaacaagcagaggacctgcgtacaatggatttcagtataacagcgaggccggtgcacgtgcagttaaattgaatcttccagatggctcacagttctcaacttatttcaatggaggagccgtttttgttgatgcagataaatttgataatgtcgagatcttggccacgtacgcagaacacccggatgtgccttcttctgactcaggaaaaggtcaaagtgaaaacccagctgctgtagtgctatgtacggtcggaagaggaaaggttttactcactggaccacaccctgaattcaacgtccgttttatgaggaaatccacagataagcattttcttgaaaccgttgtggaaaacctgaaagcacaggaaatcatgaggttgaaatttatgagaacggttcttaccaaaactgggttgaattgtaataatgacttcaattatgtaagagctccaaatttgacaccactgtttatggctagtgcacctaataagcggaattacttgcaagaaatggaaaacaacttagctcatcatggaatgcatgcaaataatgttgaactctgctcagaattaaacgccgaaactgactctttccaattttatagaggctatagagcctcttacgatgcagcaagttcgtccttgcttcataaagagccagatgaggttcctaagaccgtaatatttcctggcgtagatgaagatattccaccatttcaatatacgcccaattttgacatgaaagaatacttcaagtatctgaatgttcaaaacaccataggttctttacttctatatggtgaagttgttacatcaacgagtaccatattgaataataataaatccttattaagttcgatccctgaaagcactttacttcacgtgggtactattcaggtttctgggcgtgggagaggtggtaacacttggattaatcctaaaggtgtttgcgcatcaacggccgtcgtaacaatgccgcttcaatcgcctgtgactaatcgaaatatatcagttgtttttgtccagtatctttctatgcttgcttactgtaaggcgatactttcgtacgctcctggattttcagatattcctgttaggatcaaatggcccaatgacctttatgctttgagccccacctactataagcgtaaaaacttgaaattggttaacaccggttttgagcatacaaagttgcccttaggtgatatcgagcccgcttatcttaagatctctggtttattagttaatacccacttcataaacaataaatattgtttgctacttggctgtggtataaatttgactagtgatggtcctacaacttcattacaaacttggattgatatcctgaatgaagaacgccaacaattacaccttgatttattgccagcaataaaggcagaaaagctgcaggcactctatatgaataaccttgaggtcatattaaaacagtttattaactacggagctgcggaaatattgccaagttattatgagttgtggttacatagtaaccaaatagtaacattaccagatcacggaaatacgcaagccatgattactggtatcacggaagactacggtttactgattgcaaaagaattggtaagcggtagttccactcaatttacaggaaacgtttataatttacagccggacggtaacacttttgatatcttcaagagcttaattgctaaaaaggttcagagttaagagtctaccacttgaagcttagaagttggacggacgtaatttaaatgcatttactagcgccgttggttttcccaatgctctgcggatataaattagttacttgattccctatccctaccataatgctatgaaaaataatggtatatttggtatacgtttttattatgatacaaaaataaactagaaatattatttgagaaactatatataatgtaataacgtcaaatacgtaaggatgatatactatatcatctggaattttcattttcattatgcttttgttcgtcttgctttggagaatatgcaggagatcctgggctgtagcctggagatgttggggagtaagaaggtgaagtagggctatagtttggagaggtgggagagtaagaaggtgatgttggggaataggatggtgatgttggagagtatgaaggcgatgtaggactataacttggtgatgttggggaataggctggagacgttgggctgtaacttggtgacgttgggctgtaacttggtgacgtaggagagtatgatggagatgtaggagaataagaaggagacgtagggctgtagcttggcgacgtgggagagtaggaaggcgacgttggcgaatacgatggtgacgttggagaatacgatggcgacgttggcgaatatgatggtgacgttggcgaatatgatggtgacgttggtgaatacgatggtgatgtaggtgagtacgatggtgatgttggcgagtacgatggtgatgttggtgagtacgatggtgatgttggtgagtacgctggagaggtaggagagtatgttggggaagttggagaaaagcctggtgaggagactccaaatccgggagatgtaggtgcttcaccataagcaccaaatggagacgtggcttcaccataatcagcaccaccgtacgctgtaaatcctccagccatagcgtcatttgaacccgaatcaaccagaggtgaaaacattagctcatctttaacgtcaagatctgcattgaccaaaccactttcgttactgtatggtgtgacgccaccatcttgtccgtcttcaatctcagttattttttgttctggcatgtattttaccagtgactcctcatcgatcatcacatcaaatgcaccggtaccgattggagccatttgaccaagaatgacattttccgaaacaccacgacaatcatctaattcggctgaagcaccagcttcaaacaaaatttcgacagtttcttcaaatgaacatctcattaaggcacctgtatttgatctgttgaaaccatgacgagtaacagaagttaagccaccttgggttgtcataacatcgactaacaaagccatatgacggtagttaacatacgaaccatcagaagcaataacattgtaaacttctttatacaaggctgcacgaccagcttcaatacctagaacttccattatatcaatgaaggagttggtatagattctggttgggtcgataccaggaacagtcataacttcagataagttaacaccatctgtttccaacacccattcaggttccttaacgtattcaccagttggacttggtactttacggtcatatttcatcatgacaacacgctcgatgttctctacaccacgtaatgtaatattctctaacattgtgttctcaattttcttcaacatatgatcttcttctgcttcagtctcagcatctagtgactttggacgaacaacacgacaacggatgatcaacttctcatcgttgtcttcagaccagataacaaacaaatcatttttgaatgtttgcttgattctttcaccaacctgacccattgttaagtctttatcattcattgctgcacgatccagttccagacgtaataaccaaggtgattgttggtcaaaagattgttcagcctcttcatccaataatgagaaatgaagttggataatttcttcatcttctggaataactgtggaacgtggatcaggatcatagtaaatttctgaagcaatagtgacactctttaaagtggtatgctcgatagcagatctgatcaacttcgcttgttcttgatcggcagcatgaccaggctctaagtatacagtcaaggaaggggttttcatgtttttggccacattcaaaatttcctttaaacgggggacaccagaagtaacttttttggaagcaacaccagcaaaatggaaggtgttaagggtcatttgtgtggctggttcaccaatggattgggctgctagaacaccaaccatttcaccagggtgaacaacagaacggaggaattgtgcctcgatattacttaatacccaatcgaatgcctgttttgttagtctgtactcttgtagaactctacgtgtggccaaacgggaacgtaataaacagcagaacaatgtaactgcatctcgctgggcattttgtataatttcattcttaccacgcaacactaataagttttcttgcaaatcctttacaccaagaacgatgtctttgattgttaaatcagatggtttcgtatgatctatgtggaaagtttgttgagcattttgaataatacgtcttatgttgactggtaatggccagtttgcttcaccatcaacaaaaacttccctcaaaaatttacgatctttcactaattgtttgtattcttcatccaggagaacttgaagtttcaaatcgccaagtatctcagatccggattccaatagtgagggatcaagggtatggtctgtattcaataaatcaactctgtatctcttttcaaaagctgcatcggagccaccaatagtatctagcgattgcttttcaatatgcgcagcatccataccatcttcaccataaataaactgaataacgttacccaatgagtttcttgtggtgttatcgtaatgaaccatgatatcttctagagctttcactaaacgacgttgaatataacctgtttcggctgttttgacggcggtatcgataagaccttcacgaccacccattgcatggaaaaaaaattcttgtggggtcaaacctctcaaatatgagttctcaacaaaacctttagactctggggagtaatcatctttagagaaatgaggtaaggtacgatcaacgaacccaaaagcaatacgtttaccttcaacagattgctgtcctacacaagctgacatttgcgcgatattaataaatgaacccttggaacctgccataaccatttgtttcacattgttcaaatctttcaaattgacttcagctaaacgacctgccttatctcttgcttcatttaggaaccgaacaacgttatcctcaaaagactcacggagagtcataccatgtttagcagtcaataagtttgcctgggcttctttcgtaacatccaaaactttctttttagcctctgcaattgtctctgtaatttccctcattgttgggccgtccgcaatggtatcaccaatacctgttgaaaacccattatgtagtaaccaaaagttaacaactttctgtatgttaccaaacaacttagcacaaacttgaggtcccttttctctcgtaacaacatgaattaaaccaccattggaggaaccaacggtttttttctctactacaccaaaaatgatttgaccgtcaataataagcataccattatcctttggagaaagcagagtagtgccctcatcaaaacgttgtaaatgaataccgtttgggatagccacagacaagatttgtttaccggaccacaaaggtttgggcttgataattgcaggtgtcggaataacaccatcccaatctggaacccaataaagcatattcaaaacttgatcaagttctataaatgtatctcttaatgtcagtttacgaataccacacaaagtatcttgaacaatacccatacaaggtttgttagattgtggtgaaacaatttgcagaggaacagcacataattgagaaagttccgcccttgtttcctcagactgaggaacgtgaagattcatttcgtcaccgtcgaaatcggcattgtatggagatgtaacggacaaattcaatctaaatgtagaatatggaataacttttactctgtgggccatcatggacattttgtgcaacgaaggttgacggttgaataaaactggatcattgtccataatatgacgttcaactttccacccatactgtaattgaatatcacctgcccttttactgtatcttaaatctatacggtctccgctatcacgaatgacgtatttggcaccggggtgctcatttggtccattcctaacaagttgcgtcagacgatctatgttatatggtgtgaccacttctgggtatgttaaagtcttggcaatagattttggaacaccgacttggtctaattccaaattaggatcaccagaaataacagttcttgccgaaaaatccacacgcttacccattaaattacctctgatacgaccctctttacccttcaaacgagcacgaatagatttaacgggacggccggacttttgaagagcttgtggttgaccagcaatatcattatccatataagtggcaacatgaaattgtaataaactctctgcttcttcaatagcatgatgtggagcaccgttatgctctagtgtttccaaactaatattagcttttaaaatatcagcaagtttaaaggttaaatcatcctcacctctttgagattcattgaaggaaatggatggacgcaccggtggtggtgggacaggaaggcatgttaaaatcatccattctggacgagaaaaaacttcgttgaaacccaaactagtgaagtcttttactgagatatgcttaaaaatattcaagatttcctccgtacttaaaactcttagttctggttcatccgcatcccccgtggctctatcttttttccaactaccaactaatttcaacccatccttacgaattgtaggctgtgtattaccacaacctccccttgatacgagctgagtaggatcatcttcagaagggacatctgtttcgcagaccatttttgttttacataaagtccaaattgcagcaaacctttttttactgtctttgattgctagagcttgtctcattaattcattatgttcatccagtaatagcttaccacagtgcatacagacacactcacatactttcttaattttggcaataaaaccaacatgaaatacaggttttgctaaatctatgtgaccaaaatgaccaggacattcgttcataccctcttgacaagtttgacacttcagattacgatcaatagagcctaacctagggtcgtttagaccaccaattttcgctctcgtctgggtttcatccattgtctctggaaatctaattttggccacactgattgctctaacttcttcaggtgagaaaagaccgaattggacctcttttactgtacggagtggagcactagaatactgttgtcctaccatgtctgatttatattttggggtaaagtgttattgctatctttatgattggtccctcttctggaaaaagaaaaggtaaaatttttttgaaatttggttaacaaggatagaaagtaaaaaatggtaaatttttttttttggagtttctagttgaggtttttataattatattattattaacagagtttgatttcttagtcaaatattctggtagataaacttgaggatatcgtatttcaaaattaatctggaatgaaaaaaaaaacctcttataatacagtagttttagttttccttgaaagttgatcagggaattcgctaggaaaacttatgcagaaaagcaaatataaacaaatggttaactttggagggtttttatctgtttatatcgatcctgttcaaattttattggaaaatgaaaggaataaaaaaaaatggaagataaaactaacaaagagagtcgatcagaacaacacagatatgatttcagttaatgaacgaatcggatgttcttatgatacctctgtgagagcaattaatgttcttgctgcactctaaaggacgatacaaagctggcggtgaatggtgctgcacgctcttcttgtttgtccacttgttgccactgaacaaactaaggagaaccgacggtcgaaatgaaaaaaaaaaaatgtttaaaaccgacaatcgtctttagtgagtaaagtcatgcgggtaatggaggtccgggttaccgtatgatagtccctaatatagactcatatatatatatatatattctgatggtaatgaaattcgaatatacggcattttagcaccttaatctcgtaatatccttttcgagagtttggcctcgtacttcttgaaatctgcgtctatcaatttctcgtctttttcctcttcagtgtcgttgtcagcatccacctctgaatcgcttgcctcgctatcgttagcccaaagagtatattcatcatttttatcaccatcttcctcgtcgctgatgtcgataatgtctctgagcacgcttgtgtattttgttcttttatctttcgtgctgttgttggccgtcagcgtcttgatatgcccattatcttcaactatttcaccagttttcaggtctacgaggtctccttgttcttcaatagactcgtatttgcttatgatgttggaccacacttttctcatgttttcgtctgctagtttgtggcgctccatgacttcatcatcggttagtttagggatgatgtggttttccttggacattatatacacatgaccatttctttcagcaattggccgtgaaattccatcgtcctttttggtcttccgtttttcgatatttggcggatatactcgatgaacaggattgcaatcgctatgttttcgtattttggactcactcttcttgccggactctttcaatagtccttttaaggcaccatggagatttttcaggcttcttcttttagaaattttcttattggttttcatccttctgttaatttgtagtggaggcgtcgatatgctgtatcccactttttgtttatatatcatctgatccattagctgaaaaatcgcggtactgaagcttttttcatggcgcccttgaaactttctccttccgcctgcgcattatataaaatacgttacaataggaaaagatgacagttacttaaagtaaagcttcacagcttcagacaaaaaaagtatgaaacttgtgaagatgtttttatgctgatccggcagacggccattccattatttagttctgattttagtggaaaaactttcgaaacttaaaataataatagcccattcttggactgaggtacattttcttcttattggatttcgtttattagctgtttaacatatttctgtagggtttttttttttttttttgtacagattagaaaccatacagtgtaaaccattatataggtcaattaatatatttatagatcatcctgtcaatttttttttatttttttttgcaaagctccctttttcctgaaaccaacaacaaaatataaaaaaaaaatgataagcaggattttttcttttaataattccttaaaattaactaacaagctgaagcccttacaacaaagtaagtcaaacccaattcacaaaaaaaaaatctgttttatttcagatatgcagggtatatacatggcacagataaccttttaatgaaaagtagcaattgtgatactagcgcctttttccttgcaagaaaagggttccctgttcctgcatcgtccatcggcatagagatgtcgccgctaccctatccaattctaccgcatgcctaacaaaatgatttccgattttttcaatctaactccgtcatttcttatctgagttttcctccccgagataaattgaacaaagaatttaatcggctcatatgtgaaaaagtgtgatacttaccgcaatgggcaaaaattattaaaaaaaatctaattccgcgcttggctattatctcattaccgactcaacggtgactacctgccgtacacgcttcccctttgcttcttcctccacctcgaaagtagaacatatacatggaacagacataagctcttcagcgtatctatttcataagtggagagcatcgaacaataaacctttgcctaatttcatataacatccagtattcattttttttagttgacgctaaggcattcgcttgtgaaattaaagagcagatcaggaatagtatcaatagtctaaaccatcaagttgcacagaaaccactatatatatatggaaatatctcgaatattgcttgtatgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataaaaaccaatagcatcttacgatcgttcgaggtcttataaaccgttttatataaattattcttatacacgcactcttgagtttcttttaacattccaacatgatagacatagaaaagaattatagataacacataacattactcacaagtagcccatgagtttgatttttcctcgttaattcggtgtcaagtggaatacaaaatgggtcaactgatcataactattacccggataatctacatcatgtggtacgttaacgatgtatggtttcctaaatcaccgggttccagatgcgggttgttgttgttcgatcttgcacctccacgtactccttttgaatagtacacatataccttacaggagatcggacgtgtgcgattattgttacctcgtcacctgttatcggttgaactgttttagctctttccattccctttgttaatagtagtttaattcttcggaaactttctacgcagactcaagttgcaataggctaaagataaggcagacactttgtatgtaacgagtttcattaggagggatagacgcacgacactatctggtactacgtgttatatcatacccagaaggaaggactctctccactgaacggtgggatgagttcctaaaggcgcccctttatttgatcaggaagccgtattgattatctaatagggcctagttatcctaattgtggggagtcgagcagtacggctctgatgtttttcgaacgaagataaggagttgacatacaaagtcaacagaagttcttcttgttagcgtctctgtgctcaatatctctctttttttctttaagtagtaattactaacatcagccaaccaatagagataaaaaaaaaaggaattaagatttcatagagaaaagatgggtctatacgcttctaagttattcagcaatctttttggcaacaaagagatgcgtatacttatggttggtctagatggtgccggtaagaccaccgttttgtacaagttgaagttgggcgaagttatcactaccattccaaccattggtttcaacgttgagactgtccaatataagaacatttccttcactgtctgggacgtcggtggacaagacaggattagatctttatggagacactactacagaaacaccgaaggtgttatttttgtcatcgattccaacgatagatcgcgtattggtgaagccagagaagtcatgcagagaatgctgaatgaagatgaattgagaaatgctgtctggttagtcttcgctaacaaacaagatttgccagaagccatgtctgctgctgaaatcaccgaaaaattaggtttacattctattagaaaccgtccatggtttatccagtctacttgtgcaacctcgggtgaaggtctgtacgaaggtctggagtggttaagcaacaacttgaagaatcaatcctaatctaaatctgtatagaacgtttagtcatgcggaccttgtgtgttttgtttctagattgttttatttttatgattgttgaagatataaaccactgtatagttgtataagataggataatgatggtgcactgaaaataaacttactagctctttaatattgcaacggcttgtaacgggcgccatgatgacattcagaattataccactactatatgaaaaaatgaaaagaggccctgctttgaacccgtacattttattctataatattgcatctgtggtttgcctgacggcagcgagtccaacacaaagtctggcatatgctacgaattttccaccatggattcagcacccaaacatttgaattttttttcatgtcgattgtgaaattttactgaagatgagggtaaatagaggcctgcaatcgtcatcatatgagaaatggatatattgaaaatctactcacatctcttttttgggggtttggtagtacagtgagaacacgataaagaaccaaataggactaaaaatggtatgtagagatgaatatacatgaaacggacgtgatataatgtgctatggaagaaaaaagtctcctttaatgtctgcaggataaataatcaagtggtctgaagaaaatttacagctacagtattactgcaaaccttgcaggcaaatatcagagagatctcaccagctacaacttggtaacagaaatttataagtttatggcacttgttaaaattgtttggaagttttcgaaattataatattggtcttcagaaacctggaaccacatgtgaactattttttttggataatgcattgcacagagcgtattagtgtatacgagaatctaaaaatttgaaactggctcataaaaacaggaacttttactaacagttatgattttttgttcccattttcttatcaataggccggcgttaaagcttacgaactaagaaccaaatccaaggaacaattagcttctcaattggttgacttgaaaaaggagttggctgaattgaaggtccaaaagttgtccagaccatctttgccaaagatcaagaccgtcagaaagagtatcgcctgtgtcttgaccgtcatcaacgaacaacaaagagaagctgttagacaattatacaagggtaagaagtaccaaccaaaggacttgagagccaagaagaccagagctttgagaagagctttgaccaaattcgaagcttcccaagttaccgaaaagcaaagaaagaagcaaatcgctttcccacaaagaaagtacgctatcaaggcttaatttcgttagattatcattttaatatttgatttttggatatagtttaatttgtattttttaagaacaccaaacggcaatttattttattagtgatctactagctaaatcaatatactacattaaatttttatttgccatctttgtcataggatccgacgtcataatcagtcaggagccctacccctatacttcaatttgaaattaagaaaaaaaaagtgtagtagaacaggaaagtcgtattaatccatatgtagataaaggtatgctcttgtttatacaggccatatctacattgtgcatttcaagaacttattattttttgacaatttcgaccccccaatttaaagtcaagtggttagttttatcatcatcaatgaattttgatacggcactgtagttacctcttgctaaaaacccactaggtgcttcactttccggtagttccacctcataaaatggtttggtcttggtattaggagcatacgatcccaaatgatcgtctatcttgtcaacggcaatacccgcttttttgatatactggacatatcgcaaccctgtgataatttcatgttgaactttgaacacaatcttcaacttataaatagaattttctttaattttgtatcttttagatgccagttctttgattgtcttttcgttggtaagatcaaatgtgataggatttggttctgtattgactagtaattgaattttttgaacaaccaccttccttttgtcaccgggaaattccaatggcaagacgtctgaacttagacccaaagactctttccatttcgccaaggattcgtcttcagcatccagatttttgtattcgtcaacagtttttttggctgaaactttatactgatcgttgtttctctcctcttcgaattgactaaagtcggtactttcttcggccattattcagtttttctctaataaaaaagctcaatactcgagttattcgtgtggctagaaaaagaatcaaagtaatacaagcagcctgaagaatggaagttctttccactcaatctttataacgtttccctgatctatcgcgaaatttaaacgatcgcgttagagaaccgtttcacccggagtaatgatcagaatgattaaagcgttggggaggaaaaaaagcctcgtattgattgatatatctgaagaataataaaagaagaaaatttgcaaggcaatttgcagtttatttttggctaaatgtgtaattaactatgataatggtaaaggagaaaagtgaatatatatctatatagatgcatatatgtatacatactcataaaaagtaatctggcgtctttctgctgacgctaggttcacctggtcttacggatgggtcgtactgtaagaattgtctattatgattctcgtccacttccatgatagctgcttgattaccacatctgtagcagtaattaggagcactgaaaatggtgacaacattttgctggtgagaccaagcatagccttccattaccaattggtgagctcttgctattagtgatagatcattagtgtgattgaattgctcactgacatcttgtccaaaagtgaagcctgcacctctgggactgattccccatccgcctctatcgtcagggtctgaccatagaaggtcacacataggaccttcatgaggcacttcctgtattctgttcaactctctcacctgatctatggtttctatcatgggggaaagtcctccatgcagacagaaaattttattatctactaatgcggttataggaaaataatcgaaaagatctgtgaacattttccacacgtttgcactgccgtactttctcaaacattcatcataaaacccgtatacttgggtaatctgcctagactcgtgattgcctctcagtatcgtaattctatgtgggtatctgactttcatggcaactaggtaagatacagtttcaacagaataatatcctctatccacgtaatcacccatgaaaaggtaattggtgtcaggacaagggccaccaatcttaaaaagttctaacaagtcatggaattgaccgtgtacgtcaccacaaatggtaacaggcacgttaattggtttaacattctcctcgaactgcaacacgtccaccgccattttacatagtcgtgctacatcgtcttctgatagtggctcgcatttactcaaatgctcaatccattggtcaagctgatttatatttgtgttattcagttctagtggtttggaagatttgtgatctgctatgcccgaggaaccaggttttaaatcatcaaccgagaattcttctgcattattatccgatgaattgttgttgagatccatatcttcagatactgtgggagtcagctgttcggtaacagcatcttgcataggcacatctaaatctgtatccatttttctttttgtttattgttttatgcgataatttatatccctctttccactatgaactaaataggggcaaaataatttgtttttttctttctcttttgccttatttcaaaaaacacaaccggtaaaattaacagtttaaaattagataataactctattcaacctgaactcactaaactcttactaaattactggtaaggaaagaaaactaggggaagacgagtgaaaaaagagcagtccaacaggtgtatttctaagaagaataaaacactttttgtaaatatcgtgtccactggggcaatttaatttacactaaaactaattggagtatgtgtatatcaaaatcaatgaaagtgcagcgtctgattcactaattacctcctttactgtgaaacggtgcgtcgaaaggaacctgtaacaaaaacctgctaaaaagaatgccgaactaatgtaatccggaaaactatttctactactatgtgttagtcgattaaaatagccgaaaatctttcaagcacgacagaaagattcattatcattctccatttcacaggtattccattttccgttcattttttcactttttgattttatccttaaaacccgcccggttcatcactttgcacgccacagaaacctcagaataagctaaagggtaatataataaagcccttcgattcaataatagcattacccaagaggcatagcggcaaactaagttgacaacacaaaatcaaatcgcttcatttttattttattaatgatattttattagagaggaaattatgtaatatctagatattaaatataaagtagatctctgtctaaaatattcttaacaaaatcttatattcgaaaggatgacggtccaatcaaaggattgtataagagaaattagttttcgaaatcaatttttacttgacctgaacttaacgatttgctctcaatccgcttatttggatctggctctcaccttccgtctctttctcttaagtcttctagttctcttctttctccacttagctctcatttggaattaagtcgatatgactatcttaggattgaagtaaaatataagatgaaaacagaaaacaagcgaaatttcaaagagagaagtgaaacaataatgacggataacaattatttaacattcagaaatattacattcgttaactctccatatatataaatcaccccagcagaggaagatgggatttctgccagcaatgatgacgggtaaatggatagcatcgcagctgcgacaccttttccatggtgcgacacgcgtcgtacaatgacctaaaaatcctaaaataaaataagatgaatctaataaggaaaggtactggtgaaatgagataagggtgtacgggtgtggtaaccgtcgtgaaataaagaaagcattctgaacgatgaatactaaataagggaaagtggaaataaacgaagtgtcgaaagaggagaagaggtcttggctttcatatagtggaagaaattctaagctacaacacaaagtctccaaccaccttttgtttagtcaattataaaaatactttgattgctatttcgaaaccgtgagattgctgagaagggaaagtgaatgatatttttttgcattttttgaggcgttctttttttttacactgacaaatttaatgggggattctaattccagccaagaagcgtattctgatacaacatccacgaacgcttctagaatcgcagatcaaaatcaacttaatttaaacgtggatcttgaaaaaaatcaaacagtaaggaagtcaggttcactggaagcattacagaatgcaaagatacatgttcccaaacacagtgatggttcaccactagactatccaaaattaaatacttacacgtttgtgcctaccacagtgccgccttatgttttagaggcgcagtttgataaattaagacttcaggataagggcaccgttgatggaaatgttaccgatgataaaaatcttccaaaagagtttaaatggggccagtttgcatctaccatcggctgtcattctgcatacactagagaccaaaactacaatcctagtcacaaatcctacgatggttactctctatcatcatctacctcatcaaaaaatgcggctcttagagaaattttaggtgacatgtgcagcgagtggggaggtgaagaacgactagaaggtgttctacattcagaaataggtgccaatttagagttcaacacgacagaagagagaaaagagtggttacaatatatcgaaaaggtaaaagatttctattacggtgataataagaagaacccagaatcacccgaatcagtacacaacaaagtttacaagtcagattgggtaaatgagctcaataaagagagagaaaagtggcggaggttaaagcaaaggaagttacaacagtggagacctcctttgacgtcgctattacttgataatcaatatttgattttgggtttgaggattttcactggtatattatcgtgcatttcacttgctctggcaatcaagatttttcaaaactcaagatcaaataacaccatcagtgaaagtaaaatcgggcaacaaccaagcaccataatggccatctgcgtcaacgccgtggcgattgcgtatattatttacattgcacacgatgaatttgctggtaaacctgttggtttgaggaatccgttaagcaaactgaaactaattttgttggacttactttttataattttttcaagcgctaatctagcgctggcatttaatactcgtttcgacaaagagtgggtttgcacttctattcgcaggtcaaatggaagcacgtatggatacccaaaaataccgcgtatctgcagaaaacaggaagctttatccgcttttctgttcgttgccttgtttatgtgggtaatcactttctcgatcagtattgttagagtagtcgaaaaagtcagttcaattaccaacagaaactgagctcgacaaatatagaaattaaaagaattcttttagataccaagattgacatttatatgcattgtatatttttgacttaaaaaattactccggcttggcatttattcattaacggcgggtttgattatattaggctttgtgcgatataatatgtattacccgaagggagggctattgcactttcttttcctttccgttttaagggccctttttcatttcgatgtttgatggacacacatgaagtgaaatgtggcaaatagaacatctagaaaaactagggcattaggtaaagtaccccagcagaacttcactttacaacgcaattgattcatatcactgctcttttatattgtcctttttctcttttagagcttttcatccgcatcttctaacttctgtgcacccctttcattgttgattacattttacctcagttacacatttcttttagcaattcgacattgcttctacttaccgataaataagcgtacatttttgagtcttgaaaggattcttacatatacctaaacaaagaataacaacaaaatcgcaagcagcaaagcatgtctgagactctgcctagatctgatgatttagaggccacttggaactttatagagccaggaattaaccaaatactgggtaatgagaaaaaccaagcatccacgtctaagcgagtttacaaaattctttctccaaccatgtatatggaagtctataccgcaatttataactactgtgtgaacaaatcacgctcgtctggacattttagtactgacagtagaactggccaatcaacaattttggttggcagtgagatttacgaaaagttaaagaattatttgaagaattacattttaaattttaagcagtctaattcagagacctttttgcagttttacgtcaagcgctggaaaaggtttacaataggtgccatttttttaaaccatgcattcgattatatgaatagatattgggttcaaaaggaaagaagtgacggcaaaaggcatatttttgatgtaaacaccttgtgcttgatgacatggaaagaagtcatgtttgatccgagtaaagatgttttaataaacgaattattagaccaggtaaccttgggaagggaggggcaaataattcaaagaagtaatattagcactgccataaagtctttagttgcactaggtatcgatccacaggatttgaaaaagttgaacctaaatgtctacatccaagttttcgaaaagccatttttaaagaagactcaggagtactacacgcaatatacaaacgattatttagagaaacactcggtaactgagtatatttttgaagcacatgaaatcatcaaacgtgaggaaaaagcaatgacaatatattgggatgatcatacaaaaaaaccactatccatggcattaaacaaggtcttgatcacagaccatattgaaaagttggaaaatgagtttgttgtccttctggatgccagagatattgaaaaaattacttctttgtacgcactaatacgcagagactttacattaatcccaagaatggcttcagtgtttgaaaattatgttaaaaagacaggtgagaatgaaatttcgagtctactggcaatgcataaacacaatattatgaaaaacgaaaacgcaaaccctaaaaaactagcactaatgacagctcactccctttctcctaaagactatatcaagaaattactggaagtacacgatatattctctaagatttttaatgaaagtttccccgacgacatacctttagctaaagctctagataatgcgtgtggtgctttcatcaacatcaacgagttcgcattacctgctggatctccaaaaagtgccacctcgaagacttccgagatgctagctaagtacagtgatatactattaaagaaggccaccaaacctgaagtggcaagtgacatgtcagatgaagatattataacaatattcaaatatttgaccgacaaagatgcgttcgaaactcattatagaagacttttcgccaagcgtttaattcatggcacttcaacatcagcagaagacgaagaaaatattattcaaaggctgcaagcggcaaatagtatggaatatacaggcaagataactaaaatgtttcaagatattagactttccaagatcttggaagacgattttgctgtcgccctgaagaatgaaccagattactctaaagcaaaatatccagatctacaaccatttgtattggcagaaaatatgtggccattttcataccaagaagttgaatttaagctacccaaggaattggtaccatctcacgaaaaattgaaggagtcatacagccaaaagcataatggtagaatattgaagtggctatggccattatgtcgtggcgaattgaaggcagatattggaaaacccggcaggatgccgttcaactttacggtaacactgtttcaaatggcaattttgctactatataacgatgctgatgtattaaccttagaaaatattcaagagggcacgagcttaaccattcagcacatcgcagcggcaatggtaccattcatcaaattcaaactgattcaacaggtcccaccagggctagatgctctcgtgaaacctgaaacacaattcaagctatcacgtccttataaggcgcttaagaccaatattaatttcgctagcggagtcaaaaacgacattctgcaatcgctatccggtggaggccacgataatcacggtaataagttaggaaacaaacgcttgacggaagacgaaagaatagaaaaagaattgaatacagaaaggcagattttcttggaagcttgtattgtgagaataatgaaagcgaaaagaaatctgccacatacaacattggtcaacgaatgcattgcgcaatcacaccaaaggttcaatgcaaaggtttctatggtcaagagagccatcgatagcttaatacaaaagggatacctacagaggggagacgatggtgaatcgtatgcttaccttgcttaatcatctttgaaggcttgtgctgatcgaacgaagcaaatcctacgagtaaatacataagcgtatacatatatatatatatatatatatatatatatatatgtatatatatatatgtgtgtgtgtgtaattgtgtgtattcaactgaactatgaagagtctttgacctcttgagaatctcatagtatgaagatatggcacttctctttccgttgtaacatcctttaccgggcggcttttcggcctgcttgagaagagatcaggctgaaatgatgagactgacaacaaggatcagtcagtggcagagttgaaattccgctggaaatcgtcaccagcagctaccagctccaagaaatccgcgtagaaatcacgtcgcgcaatgtgcgatagtggtggaacagcgaaaattagtcactttgcaaagatgccaagctgatcgttctcgttgtgtgtgattctacgatattgcgcatgagtggtgttgagcatgcgtttgttcgcattttcatgcagtctcttatatactaatatatatatgcaacagatttcaaaatttatctttcttcttgttgcgtttaggcctttatttgctacacatttaaaagtgcaacgacaacccaagtaattgtatactttaacaaaccatgtctgaaaataacgaattccagagtgtcaccgaatcgacgactgctccaaccactagtaacccatatggcccaaatcctgcggattatctatccaatgttaagaatttccagttgattgattcaacactaagagagggtgaacaatttgccaacgcattcttcgatactgaaaaaaagattgaaattgctagagccttggatgatttcggtgtggactacatcgagttaacctctcccgtagcatccgaacaatcaagaaaggactgtgaagctatatgtaaactaggtttaaaggccaagatccttacacacattcgttgtcacatggacgatgccagagtcgccgtagagactggtgtcgacggtgtcgatgttgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtctcatgtgacatcgaatgccatttccacaatgataccggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcagatctaaatacaagctgcacaagatcagagacatcgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagagatatatccacttcgccaacagactaactggttggaatgcaatcaaatcaagagtcgaccaattgaacttgaatttgacggatgatcaaatcaaggaagttactgctaagattaagaagctgggtgatgtcagaccgctaaatattgatgatgtagactccattatcaaggacttccatgcagaattgagcaccccacttttaaaaccagtaaataagggtacagatgacgacaatatcgatatttccaatgggcatgtttctaaaaaggcaaaggtcaccaaatagtttcattatatatatagtacacatatttcaaacatacacatactgggcgttattaggtgtttaagtactggcgattaccgtaataaaattactatttacgtcaactttattcaataagctttttctcctactccgatgttcaattgaggcggttgcatctagcttgaagacggggtattttaatcaattaattgagatcaatgaatattgactctgtgcgattccccacgctattatactctcacggagtatttccgttatgataatgatcactatatacgtcaaatgatcggtttctatttgctaactatttcaagcatcattattatcttttagggggcggctggggaattatttattatatttagttcagtcgttcataagaaaattgagctctccattgtagatattaagaagcactttcacccagtcatccaaccaaacacgctatcaatatgttaaaccgttgcatttcccgtaataccaggctgccagtaaacctaagaattgcctctcgcttttattcagatggtcctctcggtggtgccggacctggtaatcctcaagatatctttatcaagagagaacgtgccaaagaggattattatgccagacaacaagagagggaacaattagcacatgtgaaggaacaactaaaagaacacaagaaaaaattagagaatttagaaaacaaaattaataacctttcaaagtgattggtcattgttaaggctaaaggttctgcagacacgttttgtacgtagaaagaagcaatcatgccaaatcaaaattaggaaatgaacatcagtggtattttataagcctgcacattatatatagtatatacgtcacgaatacaggaacaccgtcagttagagaaacgtcgcctcagtttgctcctcagatattcctttaaacccatacatatcttacacaaaacatccgtacatcagaaggattatatgaaacgcaaaaaaaaataaaattttcatttctgcgtgtcgcgcgaaggagaaatcttagaattgaaacttccggctaacggttgctaaaactagtttccaatgtaataccaaataagcatttgatgttgaatctgtaagccccttcgtgatatttcaaggttaaattacgaattgcagtttcagttaatcttggactaacaaagaaatcaaacaactaagaagaaaatgtctgactctattatttcctttgctgctttcatcctagctgatgctggtttggaaatcacctctgacaacttattgactatcaccaaggccgctggtgctaatgtcgacaacgtatgtacaaaaatgcaacctaaaacgactttgtgtgactacgaagagaaagattagacaacaatcgtcccgagaaatgcgcaattttgaataatgggggacagaaaaattccatgtaacgtttccctctaacatgatgagatactagggggcaatacatgtagaaatatttctccattaacgtatttaacggaaagcacaagtcaggatcgaattacttcttcaaggatctcattttactaacaaactcaacgaataacgactcttcctatggagcttgttatatgtatcattgaattaggtctgggctgatgtttacgctaaggctttggaaggtaaggacttgaaggaaatcctatctggtttccataacgctggccctgttgctggtgctggtgctgcttctggcgctgccgctgctggtggtgacgctgctgctgaagaagaaaaagaagaagaagctgctgaagaatctgacgacgacatgggtttcggtttattcgactaaacatacaaggaaagtcattttttctgcaacgtttttttaccctttatgtatatatatttacatataaaataaacctctaatcaatcagtatttaaaaatcggaagtaatgtccatacgaaagggctacgagaatttaaccatctcgttctttgctagaaatggcactgcgggatagcccctggttgcgggatatcagacctgtcgtcaccatagcaaccaaaaattacataaacccatggttgctcgccctttgatggcgacgccgaccgaagcttctcccgcgcacatttttaaaatttttactcatcgggaatgaaaggttctttgacacatgtaaagctccctaagttggacatacgtcggtccttacaggcttagcaatacacctataaggcactagaaacgtataaaatttgagcactttagtttctcatcccttttgatacgaaacgcgggcaaggctacggcatacaggaatttaacattttgttggctatggagctaagaagtagacggagcgcagaggcctatcttgtcacgcctgaggaacctgccaagaataagagtgaacggagcatagaatccaatgagagggtcggcacgagggaagcaaagagcgagaacacaagtgtatttagtcccgcttactctgataccgctactacagattcatcgaagaaagttgatgacaatgaatactacaattttactagtcacttcatgccatctttgaaaaacaccagagaactagaaaacacaattctcaatctcatacagaggataaaggaaggggatgatgaaacgttagttagtgagaaagatctcatattaagtgtgcttaacaggtctttagcatccacatctcactggaagttacaggcccagctatcggagttaagggccacctcagagggaaggtatgcagttgagacaaacttgttgaaaaaagaggtagaatttttaaaaaacaagaccccaaaaaccaacgaaagtgcaagttccgcagagttgagaccacttcttgaacgacctttaaagcgtaaactgtcattgccaggactagcgcaaagaccattatccactggcgctaggctagaaggaggatatggaggtgtatcgccgaactcatggaaaaccaaagttccaaaacttcctcttcctgcttcccggccgtctttgaatctttctccccaaaaagtcccaacgggtactgataaagttgaggaagataccaaaattgacacattggaattagtagagaacaataaaccgcatccaaggatgagaagaaggagtgacaatccagcaacaaacgaatatgtgagagtttttcatttggagaaaaaagaacctaaatcacgaaaaaaatagtatgctagaaaaaaatattattgaacgtcaataatttttctttctcatgggaccaaacacatcatttattctctaataatattctattctctttatttctggtttactcttttaaaattctccaaagagaaatatctccttcaattcttcagttacgaatttatgtttacttttaacctctatcatacacctttaatctaatgcctccaactgtctgtaattttagtacaacttaaaagggaaattttccgaaagtgtgaaaaaattggatttttttttctcctattgaactcaatggaagctatcagtttggagagggacaattattttccttcttgttttttgccaagagaacaatattgtagtatttaagttctaatttaatgttatatatacttatctaatagtttttttttttcaattagattgttttccttacgacgttaatcccttgtcatcctcacttacgaacttcgatgaatatgacatacgtaatcgggaatgttttgtaaactaattgacgtagttcctttttcgtaaactggactggacggcttgatcaaaattcccgaaaaataaaaatttccctcacgagaatatggaaattactatcgcccagcattattttatctcctcagagagtaaaagaagtttcctctttcctaaacttaaaaagcagtcctaaatatatagttgacttcgacgcatatcattcatcggctgctgatagcaaataaaacaacatagatacaatggatgcaactaccccactattaactgttgcgaacagtcatcccgcccgcaatccaaagcacactgcatggagagcagctgtgtatgatttacagtatattttgaaagcgtcacccctgaatttcctattggtatttgttcctttaggtctgatttggggacacttccaactatctcatacactgacatttctttttaatttcttggcaattataccgttggcagctatcttggctaatgccacggaagagttggctgataaggctggtaacaccattgggggactgctaaatgctacttttggtaacgctgtggaactaattgtttctatcattgccctgaaaaaaggtcaagtgagaattgtgcaggcctcgatgctaggtagtcttctttctaatttgctgttagtgcttggattatgcttcatattcggtggatacaatagagtccaacagacattcaaccaaaccgccgctcaaacaatgtcctcattacttgccattgcgtgtgcatccctactgattcccgctgcctttagagccaccctacctcatggcaaggaagaccacttcatcgatggaaaaatattggagttatccagaggcacctctattgttattctcatcgtttacgttttgttcttatatttccagctagggagccatcacgccttgtttgagcaacaagaagaagagaccgatgaagttatgagcaccatttccaggaatccacatcactctttgagtgtcaagtcatcattggtgatacttctaggtacaactgtgatcatctctttttgtgcggattttctagtcggtacgatagacaacgttgttgaatctaccgggctatctaaaacatttataggtttgattgtcattcctattgtgggtaatgccgcagagcatgtcacttcagtcttggtggccatgaaggataagatggatctggcgctaggtgttgccatcggttcctctttacaagttgccttatttgttacaccattcatggttcttgtgggctggatgatcgatgttccaatgacgctaaatttctccacttttgaaaccgctactctttttattgctgttttcttatccaattacttaattctcgatggtgagtcaaactggttggagggtgtcatgtctctagctatgtatattttgattgcaatggcatttttctattatccagacgaaaaaacccttgactctattggaaatagtttatgagtaagaacagtagcgcagaaattcaccattctctttttttttatattttatcttcttcgtaattctatcgatggaccaatacaaagatgattatgactagcaagtcattattatgatcgttatattatacatattatgtttacgcaactaatttttatatcgaattttatctgaaaaaaagttttcaaaaccaacaaaatattttgtacactcttcgaaactcaaattctgcaccatttccattctgataaaaggtttaatatttcgaagcttctcaactacagctcgtgttcttcttgcagcacatcagctgctttgctgcactgttcagggtaacgttattcattacaacgagaatatttaggaattttgctcaaattcatggagcttcctacatcattgcacaacagaatttcgttttgtagtatagtttattagaaacaaatgtgaatagatcatgagacgcgaagccctattttagcggattttagccttacatttctgagtgagaatgccagctgaaacacattcttgttacatctgtcacggcattccagctgtaaaaaaccagcagatatcgcataaaaaaatggccagctatagaataaaattagcccagctatatttttatagcgtcttttgatgacgcgaaaagtagacttcgcgtaacacgaaaaatgctggtgcaggtggatttttttggcagatactacggtcaattctccgctcgaagatttttataggcctggctagttacctatttagtgcaaattgggaagagatctattgttcccgcagacacgctaagtggtagctgtaacttcggagacgtgtgagaccttcctcaaacatgttacaggttgatcgatttacacatctaatgcaagtttaagtgcttcttaagtgtttttttctttagtcttataagttctcctttctttcactttataattctcctttataaaagtaagacccggtgctaaacaacctgatccgacaagagcaatttcaatacggcagcaactttttactacaaaagatgtcaaactacgaagccttgctgaaattcaataggaaggctgtatctaaggaaatggtgcaatatctagcatcgaccacagcttccattatcaaaattaagaagacgaatagtatgatagatattgcattgccagcaccaccgttgactaaattcatcaacagactgatcaagcattctaacgttcaaactccgactctgatggctacctctgtatatttggccaaattaagatcaataataccgagtaacgtttatggtatagagaccaccaggcatagaatattcttaggttgcctaatattagctgcaaaaacgttaaatgattcctcccctcttaacaaacactgggccgaatatacggacggccttctcatcctaagggaggttaatactattgaaagggaactattagaatattttgattgggacgtcaccatttccacagatgatttaattacatgtctctcgccattcttgaagcctatcaaagaggagcagttgtacaaatcgcaaagagactgtcgcacgttgaaaaatttttctgctcaagaaaaagacatagtaaacaaaacatccatttcccattcgcgctcatcgtccaatatgtctatcccatctttagcttccacttcgaccctctccacgttggaatctagaagatcgaatttatccaattatagtaacagaatacgaactttgcccgaactacacgaatccaataacattagcgacaagttttctccgcgaacatacaacatagactccaaacacgataacaaggaaataggccaataccgacaattaagccttttaattttagtaaagcgcgccctgtgatcttgaaaactgggttaaacaaacagataataaaagaagatacaaaagtaaagaaatcgaattggtcaaattacttcaaatcgtgattttaaatgtcgaaattatgcctggcctgcgtttcttcatggcactttcggaaaaggcggaagaacacaggtaaatgttcttacgaccgaggtcctacagcctcccttttttcttattttacatattaatatacataaatataccataatgcattctttttctaatgatttagctctcctttttttgacaaatttgaaaataaatataaaaagggccataaaatattgagttaaaattgacgattttttttatagaaatgacttgaatttacgatttaaaataaaaatatacctggcatataactaactatacaaatcatcatcttcctccgcattagaaccaaatgcagcacctgctccacttggagcactattattactgttagcattgtccgtagccgtagtacctaatggagcgtcattaaagttgaaattactgaattgacctctagatgctttcatttgctgtgagtatgcttcataacgacgcaattcagcatctgaaacagaacgtttagcggtcttcatagcttctgcgaaatgctcctttgtaatatatggaacaggatctacttctggttcttgttcagcctttgctccctcatctgtcatttccacgtcttcaccttctactttcacttccttttcagcttcgtgttgtctgtgagcttcgatagaatccttgatagcgtatttagcagccctctgcacaatatagagtaaatcagcaccagagaaaccttgagtggccttggcaatcgcagttaactctagccctggttctagtggtgttttccttaattgagcatttagaatagataatctagcgttttcatctggcaatggaacataaattaattgatccaatctgccaggtcttaaaatagcaggatcaatttgatctggcctattggtggcaccaatcacgaacacatttttcttagcattcataccatccatttctgttaatagttggttgacgactctatccgaagcaccaccagcatcacccaaggaaccacctcttgccttggcaatggagtctaattcatctagaaaaacgacggttggtgcagctgctcttgccttatcaaaaatatcacggatgttagattccgattcaccataccacatactcaataattctggacctttgactgagataaagttggcagaaacctcagtagctacagcttttgctaacaaagttttacctgtacctggtggaccgtagaacaacacaccctttgatggtgataacccaaactttgtgtattggtctggatgtaagactgggtattctacagtttccttcaattcctccttgatttcatctaggccaccaacgtcatcccaagtaacattgacactttcaacaacggtttcacgcaatgcagatgggtttgaattgcccaatgcgaatctgaagttgtccatggtgactcctaaagaatcgagcacctctgcatcaatttcatcttcatctaaatctatcaagtccattttttcacggatctgttgcatggcagcttcagaacacaaagaggcaatatcagcacccacgtaaccgtgtgtttcagcagccaatgcttccaaatcaacatcatcagccaacttcatgttcttggtgtgaatacgtagaacttcaagtctacctgtagcatctgggataccaatgtcgacttcacgatcgaatctaccaaatcttcttaaagcgggatcaatcgaatttggtctattggtagcagcaatgacaacaacattagatcttgccttcataccatccattaaagttaacaattgagagacaactcttctctcaacttcaccattagtcttgtctctctttggagctatagaatcgatttcatcgataaaaatgatggctggagcgttcttttcggcttcttcaaaggcctttcttaagttagactctgattcaccagccatttttgacatgacttctggaccattaattaagaaaaaaaaggcaccggtctcattagcaacagctcttgccatcaaggttttaccagtaccagggggaccatacatcaaaacacctcttggtggcttgataccgatagccttgaacaactgaggatgtctcaatggtagttcaaccatttccctaatttgagccatttgcttacgacaaccaccaatatcatcgtaacccacctcattcatattattttcttcatcttccctgttgattggctcaccttcccagtgaataatagtatcctgagcaacgacggcatattcttcaggttcgacatccacaaccttgaattcgacttgtctcataccgcctctgacaacaaaatggtcgcctttcctcactggtctgtaggcttccacaaaataaggcttcaaaaaaacatcgaaaagattaccagttataccttcgatcgtatcagcaattggtaacacagaaattctagtagcgtatttgatatcggggcaaggatgaattgtaactaaatcacccagcctaatacgtaaattgttacgaactacacggtttatcctgcatgctccgtcttctaattcgtcatcgatcaacacaattaagacagtatcttttctcttcttgcccttaacgagaacggtgtcaccacggaacaattccaatttgtccatggtgttagaattaatagcaatgacagaattgtcatcattgatagcatcgtccaccaaaagcatgttgtccttcttctttcttcttaaaatggcggtggcggttttatcctcctcacgagggtcgacacccgaggcgtccaaaagtggtttatgttcttcacccatgatttgtatatctgtcttgtagttgagccagttatcgagtcaatggcgttgagtcaaatcttaatagaactagattaattgactacatcaactgcggatctcttaaatacacggccctgatatatgtccttttttgccaccgaattcacattcgaggggttgccgggtagtgcgcaaaaggcggtaggttaaaaaggaaggagttagagctgttcataaggtatcgatagcaacgatggctagtaacatgattgttagcattatagagtggatatgaatggaagcaaacacacccatatgtataaacttaaatatgaaaagaaaacgctaaaagaaatcatagcatgcattactctaatcggagccttctagtttggcaagcaattccttgtgtagcttgcccaacttatcgaagtccgtttcttgggctggccaccctacaatcaaaccacttttctcatctctcttaggaatcaaatggaagtggacgtggtcgacttcttgatgcgcaattttaccattattctgcaacacattataagtgtccaacttcattgccttggccagtctcttggcaatcggcatagcatcggtaaggaattcgtccgggatgtcatgcaacttcgcaccatggtacttaggaatgattaaagcatgaccttcagcagtaggttggatgtccaagaaagcatacgagtactttgtttcaatcaatttgaaggatggaatttcgcctgttgcatagcggatcgattgttagtattctgctttatgtatatgtactacatagagactatcgccatcattggtgtgagtgtaagctctttattagtaatgtgacatacttttaataatcttgcaaaaaatacaggcagcatcaagcgtagcaggagcagacatttttgttgttgttaggtacggtgccgatatcaatggctccatcaatgtttcttaaaagtctggaaggcgtgctgattgtccttttacttcataatgttctccgctttccagtcgaacacacatcacattacacgatcgtacagcaatgcttcagtagggcggtaacttcttcagaagagaacggacccgccattatttctgcaaggaatattctgtaacgattcgcaccatatcttaaagcttctcaagcttactgttttatgtgacctccttttgtacttttcaagttctgtagacaagtgtcaattcaacctttgaggctacgtggccaacaaggtcttgcgcgatttaccggtgtttcctttgcgccccctgctcatgccatcaaaacggcacgctgttttgtagaagcctccatgcgtctcctatttgggtccttgcaaaatagtctaacgaaagcgcggagaattaaccggaaaaaggaagttgccacactccccttactaatccacacctaggatctcctttactcgtattttgaatatctacgaaaacactcacatacgctcatcccatatatatatatatatatatacggatatattgatagtcggatactacgtggatatggatacacatgtaaacggttgtgttaccctaaagaaacggaggtcagttaacaacacttttacagatgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataaataccggataatttatgtacgagtcatatttgttttgtataactttattaatcgactttttttgtcaggtttatcaccccgttacccatcccgccacttttcagcatcgaggaagaaaaaagggctgtacattatataaaaggccatcaaaaaataccggaagagggcatctccccaataaaggtgccacactgagcagagacagatagggacgcgcatcatgtgttgctactgtgtttgttgtaccgtttctgactttatactgtatattgttgcgttttttttccccccagctgcagtccttcttcgatctgggccttgttcatctgatttcctcctgaatgtattgctaacgctactgggatttttgcccggtatgttacacgcattctactacatcacaattacaagtcctttaaggaacgctgaatacgtctattattaccagcaaggctgggtggatagcgaaagaaacgttccttcgaatcgtcctcaaaactcgcagaccccccaaaaccgcccacaacaaggaagctccgctagaaacgtatacccgagcgttgaaactcctctgttacaaggcgcagctccccatgacaacaaacagtctctggttgagtctcctcctccttatgtgccatgatgaagctacagcaaggaaaatgaaaattccagcaagcaagcaagcgaagaccgttcttctctttcctatgatcttccttagcaaagaggtttgccagtcaaagtaaaagagctgccattaagaaatgtatttcattttgacagcttcttcgatcaataccgccagctccctcgagcctataactattttgcggatctgtaagccgtaatgtttttcccataaacgtcactgaatgtccatatatcatactaccagtaagcgcctgttggaaaccttcctaccttcatacgtgtattctgctatatcccttcttttcctctttacgtacagaatgacatctatgtaggcaagtttctttttccatcattggaaaacgaaaatacatttttcactagcaccacaaaattttcaagatggccaggctagttaaatctattatacaataattattggttatatatttaaaaaacagaaacattttttgctttaaaagcacgccatagtattgcttttaatattgtgatctgcgtccttttttttctcaggaaaaaaaaattttatacacattcaaagaatagaagcgattgtcaaaattcgcttctcctttcttttccattataacgtctgatcattttacgtcttcagtgccctcccttgttcgaaactagatactttcgaacacttctccccttttaatctacaaaattttgtatggatttgtttattgaaagcaagataaacagtttattacaatttttatttggttcccgacaggattttttgagaaattttaaaacttggagtaacaacaataacaatctatcgatttatttattaatttttggcatagtagtatttttttataaaaaaccagaccatctaaactacattgttgagagcgttagtgaaatgacaacaaacttcagaaataataatagccttagccgttggttgcccagaagtaagtttacccacttagacgaagagatcttgaaaagaggtggtttcattgctggtttagttaatgatggtaacacttgttttatgaactctgttttgcaatcattggcatcatccagagaattaatggagttcttggacaataatgtcataaggacctatgaggagatagaacaaaatgaacacaatgaagaaggaaacgggcaagaatctgctcaagatgaagccactcataagaaaaacactcgtaagggtggcaaagtttatggtaagcataagaagaaattgaataggaagtcaagttcgaaagaagacgaagaaaagagccaggagccagatatcactttcagtgtcgccttaagggatctactttctgccttaaatgcgaagtattatcgggataaaccctatttcaaaaccaatagtttattgaaagcaatgtccaaatctccaagaaaaaatattcttcttggctacgaccaagaggacgcgcaagaattcttccagaacatactagccgagttggaaagtaacgttaaatcattgaatactgaaaaactagataccactccagttgcgaaatcagaattacccgatgatgctttagtaggtcaacttaaccttggtgaagttggcactgtttacattccaactgaacagattgatcctaactctatactacatgacaagtccattcaaaatttcacacctttcaaactaatgactcctttagatggtatcacggcagaaagaattggttgtttacagtgtggtgagaacggtggcataagatattccgtattttcgggattaagcttaaatttaccgaacgagaatattggttccactttaaaattatctcagttattaagcgactggagtaaacctgaaatcatcgaaggcgtagaatgtaaccgttgtgccctcacagcagcgcactctcatttatttggtcagttgaaagaatttgaaaaaaaacctgagggttcgatcccagaaaagttaattaacgctgtaaaagatagggtccatcaaatcgaagaagttcttgccaaaccagttattgacgatgaagattataagaagttgcatacagcaaatatggtacgtaaatgctctaaatctaagcagattttaatatcaagacctccaccattattatccattcatatcaacagatccgtatttgatccaagaacgtacatgattagaaaaaataactcgaaagtattgtttaagtcaaggttgaatcttgccccatggtgttgtgatattaatgaaatcaatttggatgctcgtttgccaatgtcaaaaaaggaaaaagctgcgcaacaagattcaagtgaagatgaaaacattggcggtgaatactatacgaaattacatgaacgcttcgagcaggaatttgaagacagcgaggaagaaaaagaatacgatgacgcagaggggaactatgcgtctcattacaatcataccaaggatatcagtaactatgatcccctaaacggtgaagtcgatggcgtgacatccgatgatgaagatgagtacattgaagaaaccgatgctttagggaatacaatcaaaaaaaggatcatagaacattctgatgttgaaaacgagaatgtaaaagataatgaagaactgcaagaaatcgacaatgtgagccttgacgaaccaaagatcaatgttgaagatcaactagaaacatcatctgatgaggaagatgttataccagctccacctatcaattatgctaggtcattttccacagttccagccactccattgacatattcattgcgctctgtcattgttcactacggtacccataattatggtcattacattgcatttagaaaatacaggggttgttggtggagaatatctgatgagactgtgtacgttgtggacgaagctgaagtcctttcaacacccggtgtatttatgttattttacgaatatgactttgatgaagaaactgggaagatgaaggatgatttggaagctattcagagtaataatgaagaagatgatgaaaaagagcaggagcaaaaaggagtccaggagccaaaggaaagccaagagcaaggagaaggtgaagagcaagaggaaggtcaagagcagatgaagttcgagagaacagaagaccatagagatatttctggtaaagatgtaaactaagttataaatacgatatccgtaattgtgtaaataacaataactataattaaattgaataattaaaagtctacgttattcgttaaatcaattgtttagctagttacgaatgtctaaagtttttgtaggacaattgcaaaaatcacttccattattatacaaatccttcgtaagcttcatttttcttaccattgtacttcttcaactttttctcttcttctctccgttcatctagttcatcttcgttaattaggtcatcaatatcgaaatcgaaatcatttggatctttgttgtactgtccaattacacgtcttttaaggcctgtctttgagtctatttcaaattttctggaagcggaagaggcacttgcactgtcatggccaaggctttcctccgtgtccttcagatcaaactttaatacattggtatgatcaagtttttttttcaaatattccctcttaccaagcttaccagtcgctgactgtgctgttgcagacgatttcggttttgttagtttgaatgtaccgatgccagaaaacaatggcaacaatgcaatgaaagcaatcacaataatgagaagtaaaaaataaccgtatagattcatgctccggacttattgacttaggcaccgagaactttaagggaattcgtccttttcttttactaaacgtagatcatgggtgcttgatttagagatacaactcatcgcacttgacaaatttcaaaaaaccgtattcagtgatcatatttgaaaagtcacgtttcttacaatgtccacatagccctataggatatgagggattagtaaccgtaaatgatctctttgaatcgcatttttaattgaaagcaacctcgcttgaagacacttacaaatcgttacgtactactgaataccagaaagatagtatttcaaaaaaaactaagcgagaagatagagtgtagcaatgattaagcggtctctcgcaagtttagttcgagtcagctctgtaatgggcagaagatatatgatagcagcggcaggaggagaacgtgccagattttgtccagctgtaacaaataaaaagaatcatactgtaaatacttttcagaagagatttgtagaatcctcgacagatggtcaagttgtgcctcaagaagtgttaaacttaccgcttgaaaaataccatgaagaggcagatgactacctagaccatttactagatagcttagaagaactgagtgaggctcatccggattgtatacctgatgtagagctaagccatggcgtaatgacattggaaattccagcttttggaacgtatgtaataaacaaacagcctccaaataagcaaatttggttggcatcaccattgtccgggcctaacagatttgaccttctcaatggggagtgggtttcgttaagaaatggcacaaagctaacagatatacttactgaagaagttgagaaggccatttctaaaagccaataagtgcacttatccatcgactctcttatatttatttaaacacttgtaacgcatccaatctatttcatagttagagtctctcttccttgttattgatatgatttttcttttgtaccgtgtgtgtatgtatgtatgtatgaacgtactactaagcttcaacgtcactctataaagaaactaaaaagacacgtatttataccttttttgaagaatgcgagattgcaatgaaatatgtgtctattttttacatgaatcttttgaccaactcctcatatataccccacgcaatacctgcactgaaggcctttcttgccagcctcatgcttaacccgctaaataacttcagcacattttcatttttaactatagatgtaaatgtattgaaggagttggtaaattttgatggttccaattgcattctcgtttttatggtgtcgaacggtgccgttactgtggtggctaaactggcggatagtacggcgcttgttgtatttactgttgtagaggtataagtagtaaatcctccctcaggattgtaatgtataaacctagaaggtaataccatgggcagtaattgtttcgatttttcatatagcagcacatacaaacctgcatagggagcgtctcttaaacaagtagctccaaaccctctgaaaaatccaaaaagtccttccttagtatatatatgggtaattgcctcctttaaactggagtaattgtacagagtagactcataacggactttaatgacggtgataggcatggttatataacctaccaaacctcttgcaaatgcacctgttagtaaattttcatacatcgttaatcgtggtaagctactgctcttgttatatacaatgtttgaatcgtttgttaatgaaggcacagcattcctcctctttgccaaagatgagcgcataaggttcaaacatgataaatataaggcgctgcctattgatgttcgtaatgctgaaggtaatgtacctctccatagctgtagagggctgtctatctctttcaaatttttccataatgtagctttcttgtcttgctggattctcgtcttcaaaaggtctaaaggttgcaacgcaacagcagatgttagcccaccgaaaaagcccccgatcaaatgcgatgaatttcttggcttagttgcttgctcagtcatgtatgctgcttcacaaattgtgtaccttctagttgttcccgctgtgctatttgcttttcttttggtataagcttatccttttacttcaatcaccccctcgtgagaatttaatgtggaagcaatatactactacaccgttgacttggagattttcaagctcaattttgcgttcactcaaatctaagtcatttgaaacaaacacaacttctaaatatagcaagagaaataggtcaataacgcagacacatatttaacatttaagatactgatagatattcaaaaggaaacagtcaccacaagcgttggagattcagcaaaacccaaaaagcaagaaattacaaaatcattgtctcgctgatgaaacaccatcctttagtgtttgtatccattcagcgtaccctcttgttcttgagactggtgaatttcgtaactagttgaatattgcagggttttctttttctaaatatgtattaatggtggtgcctgtcagggcgcgatagaagtgaaaaattctcgaatggctggtttggtggccattgagctgatctgaaaaggatggtgagatcaagcttgatatcttgcatgcttggaccaactatttaaaataagtattgaaaaaggagaatttagtttcatttactctctacaattggatattatacagttaaaacaagagaaaaggccaaaattaacgggactctgtttgcataacatatctataatatcagtttgatctactgctgttaaactaatttttctttcttctgatttcacttcgtccttaatattttaacacattaactgtttgctataagcatacattgcttttaccactttttttaataatatctttttatccgtattaattaccgcatataattttagttcgaaacattaaaggtcagtcccgaagttataattataacatttaattcctgaatttaccgtattacatttaaatttgcataatggccactaacttaacatctttgaagccaccatttaaggtgaaggccaggtatggttggtcgggccaaactaaaggcgacttaggctttctggagggagatattatggaagtcacaaggattgccggttcttggttctacggcaagttattgagaaacaaaaaatgttctgggtattttcctcataacttcgtcatactattagaggagagattaaattcgagcactgaaaatggtaggcaaccttcaaaaatagtagaaagttttgaaaaatcaaataaagttgttattccaccagtaccatcaaggtattctgacgagaggccaaggcctaaaaagaagctatcttcatcaatgcccaattcacccaagaagccggtagattctttgacaaaggctagaaaggcaaaatcaaaagaaatggtaaatgaaaaaaatatctataatacccaatcctctcgacatcataataactcagctccaaatttacctttggctagccatagtaagcctcaagtacgaaatttcgaggagtccatgaacaatccgttaccacctctaccgccactaccagatttggacaatatgagaaagacagataaaagggcaccaaagaaatcatattctgcaaacgatttacatatggcacgttcttcaagagaatataactattacaaagacaaccagaaattctatgatgggtttatcccagaaaagagatattctttagaagaggactctatttcatcaggcctgttttcaaactctcagtacttaaatgattctgcttgtagtagtgagaacagttttgccttaatgagtgattttagtgccacgagcgcgggaagtttcgccagacataaatatgcacaatcgttttccgattcattgcaaagatcacagaatgcaaatggctgctctacaaagataaatgattcacaggagtttggtgattccaatgctagttcgagaaatggaaaaatgggtgatatccttaggaaaataattattccaaagaggaatacaaatatttactccagttcagtatcctcaccaaagtcaccaaaagcatatcctaaactaccagatattcagaatttaaacttgtctgcaacacccgatgaagctcgcgattggattgcggtaaaatgtcacttgaacagagcaaggactcttaccaaatatgacaaacatccgaggtatatgagagctctcgaagaaaatcgcgacttgatcttacatcctcaagattcgatttataacgggctaaataccaatgaagtcaaaggtaatacaaagcccggtttggtcgatgtggaactggccgaattaaacatagaatacattgataagatgacttggaaacggtgtattagagacggaactatgacattagacagttgggctcaaacaactttttcagcaagatactcaactgttctggaaaagttaagaggcatatacattttttgcacagagatgtttgctctgactgatgataatggaacgtcagatttttctgcggaaccccaaaatttagagaaaatactatacagaaagcattgtacgccatatgaattgacatggcttttcaagaaattagcaaactcattgggaatcacttgtgaaattgttataggtttcctgaaaacaccgagtgctataaattgggagtttaagtataaccactgctggttgagaatactggttaacaaagaatggagatttattgacgttattttaggaaatgtaaccaacccaattcatgaatttgtaaataacagaaagatcaagaaagcagaaaatagctactttttgatggcaccattagaaatgatatacacacatataccgcctagggaatttgagcagcatattgttcctagtatcgatcaattatctgcattgtatctgccattagtttttccatcttttttcaaaaatgagttaaagttatacaaatttagtactgcactatcatttttggaagattctgagatctacgaatgctccttagaaattcccaatgacgttgaagtctttgcatccgtggttattccaacggataatgaagaagcttcatctgcgtacaggaatatggaactcgcactgacccaaatcaaaaagcagaaagccgagtctggtagaagaattgctctaatcaaagcagtcctaccacccaatgtgaacaaaggttcactgtacatacattcaggtgtaagaggtacgcaaacgagtattgccaatatccatccactgtccatgatggtcccattaacacataagggaagtaacatgaaatacgaatttgtgatcaagataccctcagaaagcattcagaagattgagctatacattgtcgagccacagagtagatatctatttgttggtaatgagtactcattcgaagttattcaaagtccctccgatggtattgtatacagcagtgatgaagggccgaaccaaaataggaaacaaccaatggcaataaaatcaccctcaggaagagttcatgagctagtcaagagcgatccccactttccttatggtacctggaaaggaagcattaaaatcaaagagcccggcgtctggagcgctttagtgatcgctgactctggtattgggtggtccgtttttgctgaatggttgtgcgtataaacgtttttcacaaatttttttacagcgctataatctgtatcattcaacatacattctactcaggaaggtgaatttcataactcatatatggctatatagtacttattatttaatgatttatccattgcattcataaaagctatgctggtccaactttttcgtatttagtgatgttttcggtgaagaaaatatgaaaaattagaccaaatgctcaaatacatacgacatttgaattgtttaggcaagtccgaaaacgaggtatatcagctaattcaacctgaaaaccaattgagtgctacttcgaagtaaaatacatagccatttcaaatggaattatcccctacttatcaaacagaacgcttcacaaagttctcagacactttaaaggaattcaaaattgaacaaaataatgagcaaaaccccattgacccgtttaacatcataagagagtttcgctcagccgcggggcagcttgcgttagatttggctaattctggagatgaaagtaacgtcatatcttctaaggattgggaactggaagctagattttggcatttagtagaactgttactggttttcaggaacgctgatcttgatctagatgaaatggaacttcatccttataactcgaggggtttatttgaaaagaaattaatgcaagacaacaaacaactttatcaaatatggatagtgatggtttggctcaaagaaaatacatatgtgatggaaagacccaaaaatgtaccaacttcaaaatggttaaatagtattacttctggaggattgaaaagctgtgacttggattttcctttacgagaaaacactaatgtcctcgatgttaaagataaagaagaagatcatattttcttcaaatacatttacgaactaattttggccggtgcgattgatgaagcattagaagaagctaaactttccgacaatatttcaatttgtatgatcctgtgtgggatacaagagtacttaaaccctgtcattgatacgcaaattgcaaacgaattcaatacccagcaaggtatcaagaagcactctttgtggagaagaacagtttacagcctttcgcagcaggccggtttggacccttatgaaagggcgatatacagctatttgagtggcgctattcccaaccaagaagttctgcaatattcggattgggagtctgatctgcacatacacttaaatcaaattttacaaactgaaattgaaaattatcttttggaaaacaatcaagtaggtactgatgaactgattttaccattaccttcacacgcgctaactgtacaagaggtgcttaatagagtggcttcaaggcatccctcagaaagtgaacatccaatcagagttttaatggcatctgtcatactagattctttgccatcagttattcattcatccgtggaaatgttgcttgatgtcgtcaagggaaccgaagctagtaacgatattatagataagccttatcttctgaggatagttacacatttagccatttgccttgatataattaatccaggttctgttgaagaggttgataagtccaagctcattactacgtatatcagtcttctgaaattgcaaggcctttatgaaaatattccaatatatgctactttcctgaatgagtcagactgcttagaggcatgctctttcatattgtcttctttagaggacccccaagtaaggaaaaagcaaattgagacaataaactttctaagattacctgcctcaaatattttgagaagaaccacacagcgtgttttcgatgaaaccgaacaagaatattcaccatctaacgaaatttccatatctttcgatgtaaacaacattgatatgcacttaatatatggcgtggaatggcttattgaagggaagctttatgtggacgctgtccactctatcattgccttatcgaggagatttttgttaaatggccgcgtaaaggctctcgaacaatttatggagagaaataatattggagaaatatgcaagaattatgaattagagaaaatagccgataacatatcaaaggatgaaaatgaagatcagtttttggaagaaataactcaatatgagcatttgataaagggcataagagaatatgaagaatggcaaaaatccgttagcttgttaagctctgaatcgaacattcctactttaatagagaaattgcaaggtttttcaaaggatacatttgaattgatcaagacatttttagtagatttaacttcctctaatttcgcggattcggcagattatgaaatcctgtatgagattagagccctatatactccatttctactgatggaattgcataaaaagttagtggaagccgcaaagttgttaaagatcccaaaatttatttcggaagccctggcatttacctcattggtcgctaatgagaacgacaagatttatttattattccaatctagtggaaagttaaaagagtatctggatctcgttgctcgcacagcaaccctttcgaactgatcaattaatgtattgcagaataagtttatattttaagtaaacagcaataattttatgcatttcttctatctatttcagaagtaattgacgtgattttttatagttttgctttgaatctttgtgtttccacaccggagaaaaaaaagttcatgaagtgaaaaagcggttaaacatgaattttctactatctaaagataaaattacagatgcagttacttacatacattgaacagtttctgacggcaaatttagcttctattaatttttttctgtagctgatgaaaaattctgtccctatgatgcgccaatgggtcatcaacatccgtcggaaaaaattcatttctagggtattcaatatcatctccttcatcagaatcatcttcgttatcacttatctctatttcaccttcttggccatccaagtcaatgaaattcgaggaatttatggatttcaagacatcactttttcctccaagcctgttaaaaagatccccgtactcttcctccacatcgtggtacccattagatccctgaattttatcgtcattccaagaggaaaacctgctcttattaacccctataacaatctcttcacccaatgcagctatatcctctccttcgctaccaaatagaatagatctatcatcatcttcatcctccggataatcattttggtaatagttttcgtcattagaatcctcatcgtctgaacgggcttcattgggatcactttcttcatcaagagccaaatctatatgctcaataattttcacaaaccctatatttttctcgttgttatatctagcaacctcatcgtcatgaattttctccaaatggtagatgtcaaaaacgtaatctaaactgggtagtgatgcaatttttgcagaatccccagtaaaatatttcctacttggtttttttctttctgtcttttctacacctttattcaactttaaatagtcattcaccatttgattgatctctggcggtaacccatcgtcatctacagtacttccttctgctgcaagccgctgttgtgatttttcatcatctgagtctctacgacttttttttctttgttccaatacaaaatgtcgatgatcttcatgagccagttttaagagtggcgtagaagactcttgctcggattgatagctttcagagctcacagtctttgataatttaaatatgaacttctgcttcttcactcttttcccctcatcaattactgaattgtcccagatgaacttagttagtcaaacgcatttttgttatatcggtagaataacaacacatacataatgcctgcacagaatcctcatcccttcttctctttactctgataaactcaggtgccgttgtggtactaatagtgctcattcccgaaatcttgtatgcctacctcaacaaaagctatacctcagagagcagttttatataccatctcttgttctcatcaataacttgtcttgagcattacacaatttaaatcccctgtgccgacacaaacaagagataacccggaatcaatattatctgattgggctcctaaatatcgcatctgtggacttgaatccacatgctgcgaacttatttgaagcaacaattacttctgttggaagcgtggtagtgccaaatcagacttgctctttagttttcttatgttaacgctttactgcctttttcttctatatttttgaacgtcaatatgtagcgggcgtcagcagaggaacagaatttgtgacacttcttgaatgaacatttctcatatctgaaaccgcatcatcaaaaggacacctcaatagagattcagtgacatatttaacatagttttatgggtaagaaatattattaattatggtacgcaagaataaaataaatagagcgagtggaactacaaaacacctcaaggattttccatcagtcatcctaagtctgcccagctacaacccttccatcctttctaaaaatgcaactgcactaataaccggtggttctagtggactcggatttgaacttgcaaaggaactttccagaagaattaataaagttattgtggcagatattcaatcatttcctacttttgctcaggtagaatataataacattttctactatcaatgcgacataacaagtctagatgaaattaaaaatttgaaaaaagctattgaaagagatcatggcaacattaatataattataaataatgctggtgttgctcacatcaaaaagttagaacatatgacaaacaaggaggtagaacaattgatcgacataaacttaataggtgcttaccgaatcatcagtacatttgcagaagatatgatagacaatagggaaggctttataattaacattgcttcagtcctcggagaactgactcctgcaaggctgacatcgtatggtgcatcaaaaggagcaatgattggttttcacaagtgtatgagcaggcatttcagaagtttgtccacggaatgtaataaaactggaataaaaacactactggtgtgcccgggaaaaatcaaaactaatatgtttattgatgtccctacaccatctaagttattggctcctgacatcataccttcccaactggcactagcgataatctctgcgatggagcataatcatctgcaaacactaaatgccccatattatgtgaacctagttccctttttcaaaactttgagttggccatataggcatctcttaaaacatttcagtggaatggaccatgtaacgtcaaccagcccgcgagcaataaatccgaagagaagtgcataatattttagtctatttaatacatttgacgttatttgatcttcacgttgtttatatatatatatatcaagtatgctataacgctaaaaaaaaatgctcataatactatgcaaaatcttgatgtcttttgacttctttccaaatttctaaattttgacgggcataatttctcatatatctggaataatgctttaaaatttctgataaatctacttccctttctttagaaaatttaggtagctggtcatttttgatgacttttgaaatgacctccaaatcattctcagtaacttccaatgattcagacagttgttcaatttctttcttcaaattgatacttgcggtatgcggatctgtttcttgatacttcacagaatcttttaccattgatgccaatttgttaaatccattgaatagtttgccaccatatgatttcccaccgctacctgtattattattagggcgttccagattaatagtatgacttttagacatttcgttgtcaattattttgtcaacatccttatattcattgttttgcgcttccagcttctccaactgtgctcttttggaattcagagactttttaatcatttcattttgcaggtatttcaattttctgtatttgatcaattctcttgcagaagttgccatatgaacagattcatttaaaggctcatttatattgtagtatagtcttccaactaatttttctaaagaaatcgaggaccccgaaaaggcattgcttaagtaagaaagctgttcggccaattccccaacttgagcctgttcatgggcaaactgtgcaaatacctcaccgatttcattgtaatccgatttcaaatcgtgataagtcttcgtggttcgtctattatacttataaatcccgttatctaacaagttctcatattgcttgtaatcctgttcaatattagtaaacgacttacttctttccttatccatttttttgtcgttggactccttattcaacaataactgtgacgaggagcccggtattggtaacatggcatgaattctagtggtgttagtgggatctagtggattacactggaggatgctcttcggtaaagatgaaaaagtggacgaactgttaacaaattcatgccaattatggttattaggatccaaaaaatcggtaattatagatgtttttgtgatttcttcgttcgtcaaaagtttgttcaagaactcagtgagcattcttatcctatgccgtattaacttttcatcactattattgaccgacgcatgtatcacagacaatgatagatctactgaaccagaaccttctgagggcagcaaatactttgaactcgaaccagttattgacttaccataattctttattgactgcttttctggaatcggcggtatcaacgtcataggaaacaatcttatcaagatacttctcaaactctcgaaatcgctgtaacgtctctgaacggtagaattttcaaactgaataacataggcgatgtaggctcttccttgaccttcggaaactcttttcgcttcaagtatgtgtatcctagcggacttctttctattacttacagaaggttcttctgacgcagaggtctctccgttcatggagttaatacttccactaagacttgttctacatgtttctgcattcgattcttggtttaaaggcaataatccctcagagtcatcctcgtaatcttcattcgggttctttaggttatggcttctcataccgggtatttctaataaagctgattttgtgaatcctgttggcccctcctccatgaatgggttgtctttttctaacagggctgtgtgtactaactcagtttctactttgttattgtccccctttccaaccttacccttttttgggctcttttttggcgatccaactccattcttagaaatttctgcctctgccacatactcagttgtcccatgaggtggttcagcctttcctgtattccgagtttccgaattcaatttagcattttcttggacatcatttaagtctgacattgtgtgctgtagaagacaacttttctagatggtatgttcaattgcaccaccagtattcgagctagtcatctcttcattttggagatgacttgctgtaaatcgataaatattggcttactcaatagccatatcttaaagggggcacaatgggtgagttgtcgggtaagggaatgtagatcacgtgaatgaaaattcaagtgtttttcgaaaagtttcaccatggcgatgagcaagattgaaacagcactattgtaactatataattgctagtaagcaaataagccaagccttattaaaatccggtgaaaagaattgtttaacgaacgttacaaactctataccttttttttaccagcaaaatggttggaggtgctctcatctgcaaatatttaccacgcgaagagcaactaaagcttatatcagacttgattcagaatgacagcttagaagaggtgctggagttgattgaaacttcgccactggatataacgacggacagcaacattgaaacaccaatctttgaaaaaattactgagcaggtcattgcgtatgctagtatagacggtgaagccagggaaatgtttcgctcttcgagggctgaaatgaacaaggcgctaagaacttctgcacaattactatgttgtttacccagtgtatggcataaatttcaggtgtggatgagctaccggttaaatgacatcattagcgaaaactataaacatctcttcaatgacaactttggaaaaaagattgtacaaccatttttcgattcttttgctgaggaacaaaacgctaatatcaagcatgaaaatctgcacttagatatccttagcctgcttcactacttagaagttgtatatttatttgacgaatgtaagaatggtatatcgtccaaatgcctagattttatcattgttccattgttaggctgtaattcggaagagattgctgattcctgctccaagttaatgagatggcatatcaaatatttatcgaaatgctgcaataccgatagtaactttgataagctcatttggacatttatcaaacaattgtacgctgaaggctcccaacaagcttggaagcaaaagaacagtttatcttttctcctaagattccttttagcagcagagttgtctcctgaacttattacttatataaagaccgatgcttattggaggcacattcaaacagagctggataatgatgtgcacgaacacagaaaattggcactctcaattcttaaattaacaattcaaaaactgtcatctcatggtataacattgcaaacaacattttataaatgcaatgatctagcaaatatcgagatgctgggtagctggaagaaattcaccaccttatatgaaatgattgctctggacacatcattgaatcaaatacaagcggccaaacaagatataataaaaatttttgataacgagcatttacaccatagttggggccttatcttgctttctacgggattgaaatcatcaatggagagtgtcagaaaatacatgatgacgttaatgttctcgattacaaatatgtcagcattctcttcaaacttgccattattgacaaaaactcttcttccagctgcaatgtccgctcattattttgatgtaaaaggtgtcagttgtccccatggtgaaaaactttcattatttgtcaataacttactttcccaaacaacagaaggcatatcagatatattatttgaaattttgaaattattggtggaaaaagggacctcttttgacccttctaggatatacttgtcctacggtatcttagttttcttccagaataacaaacagaaaacaatcaactctgaccatttgagtctgatcaggaaattgtacgattttgcagccgaagaagaggttctcgaaactacaatccaaacaatttacttgaagttcttactgtacattgatccatctgtctccgcatctgaattattgtttacattagtttcacacattaagttaaagggagggacatacaaatatgttgagcctctttttgaagattatagggatcttgccgtttctcactttgacgatttgcaagcgaaagaaaacttgacgacaaacatcggaaaggatactatttttgacctcttagcatctatcatcttcgatttcaaggatattgatattactcccgattttttaattgaagttgcgaagtcgaagcaagatatacccgtttacacttcaaaggcagttacttttctaactcagctactttcaggcgaaccttcgaacggttatacctatgaaaatgcaaccgctttgttgtcttacccaaattttacaatatctacatggaaatccatcaatgtgaataatttatttaagtcggtaatggaaaaattttcgcttgataaattcaagttctttgctgaaatttaccagaagacttatgaatgtaggttcgatacaatcgagctaaattttaatgaccttctgagcctatatgaaatggttaaaaagtctgccaatcagtgttcaagagagagctttaaagtgaaggacagcgcttattcttcttactttgaacttttaaataccttcctgaaaacatacgccttaaatcgtgactcttctgaaggaaatgatgatgagcttcacatactactacgcttagttgacgagaatattaacaaagataatgggaattatctggggaacctggcagtctgtaaattattgtactttatcatagattcctacatccattgctccacatctgtttctgatgatgatattttcatagtgaaattcatttttgagaaattttcgtttatatgggaatgtattaatagtgaaagattagttttgaaggaaagggatctgcatttgatgctaattaagggattatttcatcctgtgatcctgtactttggatcaaatcagtatatcgatactttgacctcgaagttggaggaacatgcacaaacgattatatcattgagttattccagaagaagcctactccctcttctcggatcacaactcagagtatttatgaagttttatgggaaattgttaagagaagatgtcaactattggtggttgattaacattatagtaggtgttttcaaacagccgcaaatggatgtcaacctttacaagctcaaacctgttatttccagcctatttgaccacaaactgaacaattattacataaaaggcgatgaactttatgaaaaggtgtacggacccgacgaaatattggctagagtatctattattgattctattttatatgcaaatgatcagttgaaaattcgattaatcgaaaaagttactgaaaaaacaaacgcactttatgctataaagagaaccgacggtgccgaagcgttacagaggttgttgcagtggcaattgttattattatcactactaaccaccaatgaaaaaaaattaagcgaaactagcatgatcagaattctaaagagtatcgaggatgaaagttcaccactagtaagagtatataaagaatggttcatttcctcaaaggttgttgattattataaaactggcaatccaaaatttgctgaggattatctcttctcattgctggaggatcatagcaaaccggtgtttgtagttagcgcagaaaaaatatgctttatggtgttgaaagatttaagaaacgacgaaaagaaatatggatttacacagttactagacagattcatttgcacgttagttcctaacgcagcttcaaacaaacctctggtaaggcatttttctaattctctaataatttcattatggcctacattcaaagcctacctatcggatcacacactgagaaacatcattgagaacttatattccaatgccaaaaagactcaaatatttggtcaatatcgtgccggggatgccaacatatgggatctgaagggtgataggaaattaacgaacatgtttggtggtgtgctcaaaaaagttaccgaccatgattgcccgtacatttctgagtctgttttcgaaaaatatttgcaggagaaagatattgttcctataggtaccgatgaaaggtccttatggcttgataaaagagacaccaatacggaatctgttaacaacgcgaacatctcctgtgacacttctccactgcaaacaaaaagtggagcttgggaaaccgttctggatctggacaataaaaaatcgaatgatgtcgttacacgttctgaattgattgtggtatcttcattagttgataagccgccaaacctgggaggtatttgtaggttatgtgatgttttaggtgtgggactgcttactgtacaagacatcaaagtcaaaaaccatcctcaatttaaaaatgttgctgtgactgctgatagatggatgcccatggaggaagttgccctagatgagattgcaagtttcatgaaagagaaaaagaaggaagggtacacattaattgggctagagcaaacggataaatcagtgaagctagacaacaatttccaattccctaaaaaatcattgatcttgctaggaaccgaagcattcggtattccggggactttgttaagcgaattggatttatgtttagagattcaacaatttggtgtgatcagatcaatgaatattcaaacggcaaccgcagttatcgttcattcctatacagttcaacacatgtaagaatcaggtttcattcccacttttgttaaccatgaagtttttagtatgtaaactaatttgtctttttatctaattgtgactatatttttataaattctccagtgatcgtactacgtcgggggcgtatttctccaccattgcaagaccttgcttcaacaaatgaggtttaaagcttttaacgtttgaatcattcaatgctactgatctgataggtgatgtaatcttaccattagaccaggaaatgattaggccattattggccacttcgctttcgttggctgcagggtccaatagcatattgttgcctacaacggccaatataaacactaaaggcggattaatgtcaagcttaaccatgtcgtaatcatgaaacgtaggaagttcttccacctctaagtcgtcaaaagctgaaataagtttcggtaggtatgtggagttcaacgctgaataaatagcaaaggatattaaagaaactgggtgtgaatgtgatgaaatgaccagaacatcgacaaatattttgaagctgtacttttttgtcaattgcaactttgaggaatctactccgctaccagacttcaaaaccttgttcagtaaagaagtgattgtctctactaccagcgcgtcatctctttggcctgcgatatctacatcgacctgaagtagttcattctccacatgatgatccacaactttggacttaatgctcacgatacattcacttccatcactagctataattctggacgatccattggaacttggtaggaagtcagtaaatatttctataggtctgaattgatgaggtagtcttccatcgggcctaattgaaggcgtgcttgctagtgaatcgtataggtacgacttttcggcgaccgaaagagacataaatgattatttcaacagaatctcaaactgtcgttgtgctagtcaaaaagaatgccttttgccgtctacagactattagtatcattgtactccttcaccatataagctctacgtttcttttttctgaatattagaaaaaaatttcgccaactagggttcaaaataatagactagggcacggaagaaaagcacaccctagggctttcggagataaattattaatagcgagttttttttgtatttacttattttattatttctttaagatatctagtagtaaggatagaacgggtagatagaatagacaaatggagttattgaaatatttatacgaagagatagaacagagagacaaagagtatgacgtgaaaatgatgcgcagtaaaactaaatcccgtctcttaaatgaatatgctgtttggtgtcacgacgtccacatttgaattgtccatgtcaacgtcagggcccttgttggtgttgtcctttgcctctacctcgtgcttactcttgccatggcccgtctttctatataccgtttcttgctccaatgcgtccactctctcattgtaattgtttagcacaatttcgttctccctgacagagtccttgtacagcgccaggtctcccgaatcaatgttctccaagtcgtcgctgtcgtcagcttcaagacggtcgtcagcaccctccaacttagctatgtatttacccaagcgggcgttagacctctgcaaatgattgatactgttctcaatttctgttttaatctgtgccaactccatgtcggacatgccgcttatcgccgtcttaaattcttcgatctggattggtcttctgataccgcctgctgagcacattatgttacttgtagtagttattatgttttgatttgctttatgttttataaagatcttacccctctttttgtcaagagaaataagcttctgaagtattgttttcctggtgaaaagtgtcttatttatatggagaagggatattcggcctcggttttaggggaggagctgaagagttgtcccgctcgaaaaagacccgtaagcgcatttatcgaactacgaagtaaaatggactttcgtaggtgtggacaatagtaaattgcaagtcaatcccgggatgacgtcaagatagacagtcaatctgtcacagaggaatgcttgctaatccaggagctggcgagctggctagctgtggagactattccaccatggtacacactaggatcctcgatcttggtgagccatgagtagaacttgtttggttccacccctccggttgccatgtttatatcttcctcagcaaactgtttatcttgcattggtgaggcgattgggtcatctctttggaaatgggcggtaacaaggtggtcaaccaccggccagccgtaagcgttggaaaaccttcttcttacgatgatgttattgtgggcatctggtttcagcaataccacgactttcctccaatgcatccccttgtgccagcggcgtgctatgatttcctccatctcttttctcgtcttcctcgtttcgccttccttggctgctgttccttcataaagtgttggtgatggaggcggtaaattcttttctgtgtagatcttatcatgtatgattgttgcgacccttgcatcgggatctgagaagaactttgcgtcggggcatggtgatagaagcacagacttcatagatttgatgacggaagcattcatcaagcgtttagatttcttgtcgcagttattttccttgctcttccaaaacgtgttccatgacgatgcattgattccatcatcatcattagcaacatcgctatgatttggaagttccccaataggacttacttcaggctggaagagaggatcacaaggtgccgtagtttgacctcccagtttctgaagtaattgagagtagtccaaaaaaagtaaagaagaggagtacaagggaactattccgtcgttgacggcattagcataaagtgttcttcttttgaatcgagcaagcacactgattaaggattcctcggatagcaggtaaagtaggggcttatcaccataatttccatccttaagacccagttcttgccccgtagtaccaatgatacccatcgacaatgacatttttacgtaattgggcgtgctggtagcaatgcctagcaatggtgacgccagtgagataaaattgattggctccactttcttaaagaaatatggatatttggtctttatgtaacaaatagcaaaagtttgtgttaatccacccagggaatgaccaataaatgaaattttcccaacagagtcatcatataactcgtcgatgatgtagtttgccaatccaacacccaaaaacttaatacccttctcagtctcacaagcattcttcatatatcccttaataactagtcgctcatttggattgttcatttgagccttgtatatttcttccattaagtattccatatctgccgaaacgtttgattgaaaaccatgcgtgagaatgactaaatgggatttttgcgacatgtctatgggtcgtggtactttccatatatctgcggtggtaagtctatgcaccgataatcctgtgtgtaaaatattgcaggctttatcaggcaatgaatcattacatcgtatttttcttttcaaagaggcctttgaattgccgactactatctcaaaagttaccttagtttctttattaaatagtatttgactgacaatatccactatccatacatagcgtggcttaatgtggtgcaaggacaactctgcaataaacttttgttgtgcctgtaggtttgattgaaatactggtttatccgccgaacatatgatcttatacgagctttcgtaatcttttgctcgcacgtcacaatataagataaatgggcccaatagataggctggtttataggatagctttgtggtatttttgatctttacccatagggaatccagtgtgatatcagcgggaatactatcaccctggtatagctcatatgtaataacgtatctttctaactcacctaactttactgacgactgattgtggtatagcacttcatcagcactcctgccagcttccatattactaccgtttccccgatgtttttgggtgaataaggtcaggtgagcattttttgtactgatattttttctctttgtttgcagacacaacgcttgctgttaatacgctaaaaacataccacactaccttgaacaaatcctccaagagaaatttgtaagaattcagaagcggtttcaggggaagtcggcttagttgtcaattgtaattgaaaatcaccctctaatttgaaagattttcagtttcaataagacatcaatcttgccagtttgtaattttttggtatatagaaatggtcttcaagcataagccttaagaaagattcgtccattggatgaacctacaattttttttgtgttatgatgtgaagcttcatttgaagcattgtgcagagaatattacaagtagattcaaaaaacacattgaaaaaaaatacaagtgaaatcacagttacttaaaagtcatcaaaaaaaatattcccggcctcagagcgaacatatgaaagtgaatatggagtacacaaagggtatgtgggggttatatattgtcgtctttcttttaacattcaataatgatactaacgttgattaatgatgattcatcgcagaaaagaaagttggtgagggtacttatgcggttgtttacttgggttgtcaacactctactggaagaaagattgctattaaggagatcaaaacatccgaatttaaagatggtttagatatgtcagctatccgtgaagttaagtacctccaagaaatgcagcatccgaacgtcatagaactaatagacatatttatggcttatgataatttaaatctcgttctggagttcctaccaactgatctagaggtggtaataaaagacaaatcaatactgtttacaccagcagatattaaggcatggatgcttatgactttgaggggcgtgtatcattgccacagaaatttcattttgcacagggatctgaaaccaaacaatttattattttcacctgatggccagataaaagtagcagatttcggtctagcaagggcgataccggccccacatgagatactgacaagtaacgtcgtaacaagatggtatagagcgccagaattgttgtttggagctaaacattacacatcggctattgatatctggtcagtaggcgttatattcgcggaattaatgctaaggataccttatttaccaggacagaatgatgtcgatcaaatggaagtaacgttcagggccttagggacacctacagatagagattggcccgaagtttcttcctttatgacgtataacaagttacaaatatatccgcccccttcaagagatgaattgaggaaaaggttcattgctgctagcgaatacgccttagattttatgtgtggaatgctaacgatgaacccacaaaagaggtggaccgctgttcagtgtttagaaagtgattatttcaaagaattaccaccaccaagtgacccgtcttcaataaaaatacgtaactgatatgattttataaaatttgtagaatctgtgttattgacattagatgtatcctcaacatatacaaataaacttcttgatgcgtcttgttttttggtgttgaattttaactcttttccatcattatggaattcgtttttagattttaacaacaacaatatgaggggagacaaacagtagcagacgaaaacgaaaacaaaagcaagaaatatctgatctaaaatatgcagaggtttgtcagtaagtttgtttccacaccaccagtacccaaaaagtttcaagagattttcccgaagaaacgtacggttaacaaaattttattccagttagatacaaggcttacataccatgaaatgtacccgatatttctgcaggtatcacaaaatactaatgaagagaatatcccatggaggaagaaatacccctatataaggagttcagacattatgcagatgcgaaacgtcttgataactctaaggacgcagaacaaattcgtccacaaagacttattagctatggaggataaattattgaatattgctgccgaacttggcaacaacgatgctatatccatcctaagcttcaacgtgatacatgaatataaaaaggaaaacgtcaaatccagttatgaaaaagacattgaaacggctaatgaattcataaagaagctgtatgcgcgtaaccatcatttaacggttaaattaataggggacctgtttttcgaaaacaaaacttacgataaggctgagaaatattaccaagagttcttgaaattggaaaatagtaccaaattggcaggcgaagttcacggaaaacttggggaaatccaaataaagcaagtcaatggttttttgaaggcagaaaagtcatggctgagttgtatagaactgctggaaattgaaagaagttcacgttggtactttctgttagcgaggttatatatgagttcagagcccatgaaagccaaagccttgctagaaaattgtgcatcaattggatttaaagaatgctttaaaacattaggatttcttgaattaaactatttcaataattatgaaagggcgaaagaatggttcaaaacgggtatggaaataatggacttggaatgtttctttggatttttcgattgctgtgtgaaagaagagaattttaaaggtgcacgagattgcctagaaagcgtaaaaaagctagggaatgataaagacaagaaaacaatgataaatgtctttcttgaaagtagaaaagattccataaagttgctggacaaagcacggctttaaatgtctgatcgattctttttgcgatttatataaggacacatgtctccacctataacgcgagcttgtaaatatctatatacccatctgataatgttcaaaaaagtcagctaagtaagtaaaataataaggacaataaaattaaaatgtcatacaatgttacctatgaaataattaggaaatactgttagagtaatatttagagttgaaaatgcaatcgcaaaaaaaaaaaaacagaattattttcatcatatccatctatgctcgtcagttagttcgttagtgttcttcaaaaaatctggagtatttgggagttcactatcagtcggtaaagacaacaaatgatcatttggatttgcaacaatatcagcatcgttggataaatgttcttgcgctagatgattctcctcattattagcattatgattgttattgctgttgacggtagtatccagtaaattgagcgtatcatccttgctagcttgacgtccattattagagccttgtccgttgttggtgttggttatcgaactcgataacagatcatgatcgaagaagagagaatcttctaaatttgtatttggatttgagtctgttgcacttgaatttgtattcagaaagggaggggcaatattctgttgtggaactgcagcagtggggatcgctgtattgatcgtaggtaatatttcattcgatgatttatagtctagaattagagaattcatgaatcttaatgatttctgtaaacctttcaaagtgtgaggaatattcgaaccaccaacaaatgcgtcatttacctgtctaccttctgagaaatcatcacatatggaccactgattgttcaaatttggatcttcatcaggagcattatttaaaaagtaaacagcaaaagtgggtgatctggtgactgttagcttcaattctccaaagttatccttagcattcctcttatcctcactactattatcattgtcttcattactgttatcgtcgttatcatcatcattattagtattactattgtttttatcgcttgtgttgttactatttattatatcgtcgtcagtttctaaagttagagagcaattcgtgactgaacttaatgggaaaaagatcctgaagagaattttagtattatttgccatggcactaaaaaaatagtttatttctgagtttttcttggatatcaaaaccattaaatctgtggcattcgacattatgttattaatctttattggcgataggtttctcaactcctttatagactgaaagttccttctttgcagtgcgccgcttttcattctattccaacttcccacagtaattgagcaaatgtcaaaaaaataatagttgttgttgctgttcagcggaatacggtcgaaaaaagtcaggtcttcatcgtgaaatatggatgaagtacttgttgtagtgaccaaattgttgtctgtactcccacgatcgtaatcgttggcaatatcacgggattgtgacgaggggattgtgtccttattacttccatgctgctttttcctcaatttagctcttctgttctgaaaccaaattctgacgtttttttcaggcattcctatcagatctgatattttctttctttctaccaaagagggtgttggatttatttcaaatttacgctttagcacatctagtgcttcaccctttgcgcgagtcctcttgggcctttgaggtccactatctgatgcattcgatgaagcactcatatcattagtatgttggtcgtggtcgtgctccaggttttgagtttgaattggttgtggttgtggttgttgctgttgattatgttgttgatcatgttgttgctgttgttgttgttgttggtcatgttgcaaataatccaaatctgtagcaaaatgtgtgttaaaatcgtgatcgtacgagaattcttccatcatagcgtattgtatacgttatttagcagtaagccgtgacttgtctagccctgttgaatgtctccttagttgtctttgcgtcttttaatagaggtttcaacagttccctggagcttgtgatttactaaatctgcaattctggatatgccgcatcgtccgaagtgatgtattaaaatactgctcataatgtgcaacatttactatcatcttgtgccaaaaagtgaccttatgtccgcatgttaaaagactattgttgctaagctattttacactatccttgatcgttcacagattactcacacatggttttacttagacgacaaacaatcccacacttttaactccatatactgttaagtaccagagataaaggaaacgcgcaacgcgttaacagaaaaggtgaaataatatcaagaagatgagataaatactagtagcagacaatcaagaaatcagagttttgcaaaaaaaagagagtacagacagagacatgtctagtacagtaatatctagaaagaggagaaacagcactgttactgagcctgacagtagcggagaaacaagaaaacaaaagaagtcgagaagtgatgaaaagagctcatcttctaaggatggtgacccccagctagaatttaaagttttacagggatatagggacctggaaagtgaaatgcacaaaggcagagctcaggtgaccagaacaggagatataggtgttgctatggacaatctgaacgctgtggattccctattcaataaggttattggtataaagaataatggattgtttgctcatgatgctagagcaatggttagtataagtgaattggctcaaatttctgtgagaaatttgaagtttgatgattcgaggagtatggtcaatttagaaaacatagtaaattccttgaaaagatacatgctaaaagagcatttcaagcttaataatatcgccgaaaataggaatgatttgacgcttgccgctgatgaacaatccgcagcagaccagcaagaggaaagtgatggagatatcgataggacgcctgatgataatcatacagataaagctacttcctctttcaaagcgacatctatgaggcatagttatctacagcagttttctcactataatgagttttctcaatttaattggtttagaataggtgctctctacaatactataagtaaaaatgccccaattaccgaccatttaatgggacctttatccatagaaaagaagccacgagtgttaactcaacgaagaaggaataatgaccaagttggtgaaaagatcaccgctgagaaaatcactcagcattctttaaactccacacagcaagaaactacccctgaacaggtcaagaaatgtttcaaaaagctttcaaaaaaattaggcccagaaggttccattaatctttttaaatttattatagacccaaattcattctcgcgatccatcgaaaatcttttctataccagttttttgatcaaagagggaaaactattgatggaacacgatgaagaaggtttacccacaattaagataaaacaaagcataagtcacacagattcaagaagtaaagaaattgagagacaaaggcgtcgtgccgctcatcagaatcacattatttttcaaatggacatgcctacttggcgaaaactaataaagaaatacaacatcacttcaccattcttagactaacagcgatagagcgctgcatataatatgtacagttttttttttttttttttttttttcatagctggtccgttctccaaccatcaacacttaataggtcattcaatggccattgcctaattggacatatatctaaatcactaactaatcgtaagctttcccatatctcgatacctgcccagccgatcataatagagttgtcactacaaaggtccataggaggataataaaaattaaaaaagcttgtggagttcaacgtccccaattccgtttctaattttgttctcaacctttgattactactcactccaccagaacatacaaattcacgcacgtttttaaacttttccggttgtgacttgagcacgtgcttcagtttatttattatatggtcgaaaacagattcctgtacttgatatgcaattgaccgtatttcgcgttctggcagttcctggatttctgttttacctagttttgtcaaattagttcttaatgctgtgataaatgctgaaaacgaaaacgaaagcatgtttcttttactagcgctgttttttaacggactgggcatttctagttttaaagcaaaatcttggtcgttaatatcttgattaataaatttctccatttctctagcgatcattgttcccttgaatccaagctctctgccacatttatctaatgagtcacccactgcaatatcgatagtatcacataatatttcgtgatcgtcaattgctcgtgacaaaacaaacgtagtatgaccaccactaaccagcaggctaacaaagggaaattgaggcacttttccatttgtacccattcttggtatcagcaagtgtcccagcatgtgatgcacaccaatcagtggtttgttccaggcaacagctaaaccttttgcaaaatctaatcctcctgataatgaaccaggcataccagggcctcttgtaacacatatgagatcaattccttctctcgcattgctttctatcagggctctttcggttaagggtcctatccgagcttggtgatggatatgagcctttgttggtataatacctccttcgtcaatactatctaaagtatctttcaaattggctagcacattaggagctgcactttttgagaacctgtccaaaactgaaacgcatgtatcatcgcaagaagtctcaatggctaaaactttatagccttttcttaactgtattggtctgttgaatgcacgcctctgccaaattctatagttatcgaggagaaatcttccggttccttttattgatatcataatgaaaaaaaaagtttctatcctttcttctactctacttatttcagagcttgagaatcgctgtttgctttaatttcattgtcaattaatcatcgcgcaatgaagatgccactctttccattggcagagcggatccgccaaatagaaattacataaaacaagtaatttagctatttttcagagtacgaaatattttattatatatattgaatcacaattacgagtacttttcaattacatgttaaaagtgcttcataagtagctcaaacagttatttttctaatactataccacttctgtcaaagactttacctttgaactgggatagattttcacctgcataactcaatttgctggaaacttcgactagtaccccatcttttacaatagcgcctgcatcttccaaccacgaggttcctagtttcaaatatgctagtctgctggtctcaggattatcgttcttagaaccaggaccgttttttaaaggtgaaaattctttgcatctatctacttctaagcacccaaacttgttcagtggtacagtgtcaaagacatcaaatatgaattgctctaattttataccgtttggttcggtaggcttagtgtacttgccggtaacactatcataagctggaattttcttcttcgcaatgtgatatggcatattctcacaccactgatccaaatcacgttttagtaaatccactaggtaataatgatttacaatgttgcctgcgcgtagttttaataagccatctttatcctttgcttcagccaattcattggaaatttcagaatattctatgacacatggtttctcgtttttagtagcaattaacccaactgattcatgcgcatctctctttctaacggctttggtggccagttcgaagccatgcttgatggcaaaaccaataaatacagggtctgcgattttagataggacattatcgacacagtacatgtaaacatgcttgattcctctcctatcaaagtcttcgttcaacttgttttccttgatggcacggtagagtccaccatttccatctggtgattgagataggtttactgggtctttcattaggaaatgcttcccggttaaatcaaaggcaggcagggttccctggttgaagaacgtaatttgttctttattcaagccaaaataattgtgttcttgaaagtatgcctcagtagccgctctagtggggcctgatgtcataatataccaaggaatttctacctttttgtcctttaccatatcttgcaacctgatcaacttttcagcttgaatttgaaaaagagatttcttagaaggcaatccaatgtcgtaacagccctttggttgagaggatcctaaccgcgtaccttgtccgccagccattaaaatcactgcgacttcacccttgccaatagcttcaaggcctaaacgccagtattcattttctttcttactgttgccaataagcgactcgtacgaagtagggggcaatggtgaaatttcgacgccagtatccttagaagagttagctagtgagaatttaatagcattttgacagtcttccagtagttttgcaggggacctcttggaagatatttgctccaggtttgaaagcaattcttcttggtctttgcgagacaagctttcccaattgtggaaaagttgactttgtccggcttcaatgaatagctgttttgtgtcagtcatagttgcagttcgatctggtgttctcctttatatctgcgtttctttgcagcgttcttgcttgacggttgatcttggttttgtgtggtaaaagtatgccttaacgtaataggcaatttttcgtattacgcgtaactttttattctataaaatgttcaatgaggacatctgctattcgcttatgaagaacaaacactcagtactactgatctaaggcaattttcaaggataaaggaaaatagatattgagcacttgctattaagcattaatctttatacatatacgcacagcaatgagtgaaaaaagatcccttcccatggttgatgtgaagatcgatgacgaggatactccccagttggaaaagaaaatcaaacggcaatcaatagatcatggtgttggaagtgaacctgtttcaacaatagagattattccgagtgattcttttcgaaaatataatagtcaaggcttcaaagcaaaggatacagatttaatgggtacgcaattagagtctacttttgaacaagacgtatcgcaaatggaacatgatatggccgaccaagaagagcatgacctgtcatcattcgagcgtaagaaacttccaaccgattttgacccaagtttgtatgatatttctttccaacaaattgatgcggaacagagcgtactgaatggtatcaaagatgaaaatacatctaccgtggtaaggttttttggtgtcactagtgaaggacactctgtactttgtaatgttacagggttcaagaactatctttacgtcccagcgcccaattcttccgacgctaacgatcaggagcaaatcaacaagtttgtgcactatttaaacgaaacatttgaccacgctattgattcgattgaagttgtatctaaacagtctatctggggttattccggagataccaaattaccattctggaaaatatacgtcacctatccgcatatggtcaacaaactgcgtactgcgtttgaaagaggtcatctttcattcaactcgtggttttctaacggcacgactacttatgataacattgcctacactttaaggttaatggtagattgtggaattgtcggtatgtcctggataacattaccaaaaggaaagtattcgatgattgagcctaataacagagtttcctcttgtcagttggaagtttcaattaattatcgtaacctaatagcacatcctgctgagggtgattggtctcatacagctccattgcgtatcatgtcctttgatatcgagtgtgctggtaggattggcgtctttccggaacctgaatacgatcccgtcatccaaattgccaacgttgtgagtattgctggcgctaagaaaccattcattcgtaatgtgtttactctgaatacatgctcacccataacaggttcaatgattttttcccacgccactgaagaggaaatgttgagcaattggcgtaactttatcatcaaagttgatcctgatgttatcattggttataatactacaaattttgatatcccttatcttttaaaccgtgcaaaggcgctaaaggtgaatgatttcccatattttggaaggttaaaaaccgttaagcaagaaattaaagagtctgtgttctcttcgaaggcttatggtacaagagaaaccaaaaatgtcaatattgacggccgattacagttggatcttttgcaatttattcagcgtgagtataaactaagatcctacacgttgaatgcagtctctgcgcactttttaggtgaacagaaggaggatgtacattatagcatcatttctgatctacaaaatggcgatagtgaaacaagaagaaggttggccgtttactgtttgaaagacgcctacctgcctttaaggcttatggaaaaactaatggcgttagttaactatacagaaatggctcgtgttacaggtgtgccattttcatatttactagctcgtggtcaacaaattaaagttgtttctcaactatttcgaaagtgcctggagattgatactgtgatacctaacatgcaatctcaggcctctgatgaccaatatgagggtgccactgttattgagcctattcgtggttattacgatgtaccgattgcaactttggatttcaattctttatatccaagtattatgatggcgcacaacctatgttatacaacactttgtaacaaagctactgtagagagattgaatcttaaaattgacgaagactacgtcataacacctaatggagattattttgttaccacaaaaagaaggcgtggtatattaccaattattctggatgaattaataagtgctagaaaacgcgctaaaaaagatctgagagatgagaaggatccattcaaaagagatgttttaaatggtagacaattggctttgaagatttcagctaactctgtctatggttttacaggagcgacggtgggtaaattgccatgtttagccatttcttcatctgttactgcttatggtcgtaccatgattttaaaaactaaaaccgcagtccaagaaaaatattgtataaagaatggttataagcacgatgccgttgtggtttacggtgacactgattccgttatggtaaagtttggtacaacagatttaaaggaagctatggatcttggtaccgaagctgccaaatatgtctccactctattcaaacatccgattaacttagaatttgaaaaagcatacttcccttaccttttgataaataaaaagcgttatgcaggtttattctggactaatcctgacaagtttgacaagttggaccaaaaaggccttgcttctgtccgtcgtgattcctgttccttggtttctattgttatgaataaagttttaaagaaaattttaattgaaagaaatgtagatggtgctttagcttttgtcagagaaactatcaatgatattctgcataatagagtagatatttcaaagttgattatatcaaagacgttagccccaaattacacaaatccacagccgcacgccgttttggctgaacgtatgaagaggagagagggcgttggtccaaatgttggtgatcgtgtggactatgtcattatcggtggtaatgataaactttacaatagagcagaagatccattatttgtactagaaaacaatattcaagtggattcgcgctattatttaactaatcaattacaaaatccaatcattagtattgttgcacctattattggcgacaaacaggcgaacggtatgttcgttgtgaaatccattaaaattaacacaggctctcaaaaaggaggcttgatgagctttattaaaaaagttgaggcttgtaaaagttgtaaaggtccgttgaggaaaggtgaaggccctctttgttcaaactgtctagcaaggtctggagaattatacataaaggcattatacgatgtcagagatttagaggaaaaatactcaagattatggacacaatgccaaaggtgcgctggtaacttacatagtgaagttttgtgttcaaataagaactgtgacattttttatatgcgggttaaggttaaaaaagagctgcaggagaaagtagaacaattaagcaaatggtaaaaaacgatagggtggcacatcatattaggattaagaaaggctaacaactttttgcatgttggtggatatatatgtatatataaatagatacttggaaaaatccagattcaaacaatgtttttgaaataatgcttctcatgtttagaggcaagataattctgagtatgttttgggtattttattgtcagtaatttgtaaacgctgcaattctaatgagaccgagctttgttgctgtatgtcattgaaccaagggtggttcaaagcttcatctatattgtacctttcatcaggatttaggaccaaaagattggatattaaatgtagtactgagtcatcgattttatcccagtacggagagtaaaacgcatacttagcttgtaagatctgttccttcaatgaaggtggccccaattgatcactgaatggaggaaaaccacataaacagacatataatatgacaccagcactccaaagatctacttttgatgtgtatcctttctttgtgaggacttcgggcgctacataagaaggcgtaccacaaagtgtgtttgtgaattgcatttctcctgtaaattttgctaggccaaaatccgctattttaacttgaatatcaatttcatcttcatcccatgggccaagttggacttgacttggattttcgcgccttgttatatttaataagatattttctggcttgatgtctctgtgaatgatgttttgctcatgcagatacttcaatccggtaagtaactgtttgaatagagctttggattcatcctgtctcaaacatgtttttctgacgattctttcaaatagttcgccatcgtcgatcttttccagtaccaaatatttttgaatctgagatttgctgattggctctacaaaactatctagtaagttgacaatgtttggatgttgcactctcattaggatgttagtttcctccctaaattgtttattctttttttggtcgtcattttgctgagcgtggaatattttcacagctacttgctgaccagtttttttgtttttggcttctttcaccagggcgtagtgccctgcacctaattctttacctaataaatatttatcaaagaacgacacaggccttgtcttattcagttttctaattgcggcactcgttgtagcattttggctacttgtagcacttatttgcggtttcttgaaaacttcgtcgtcgttcttatatgaacgactttctgaacttaccttttcatcgtcattttcgatgtcagtagaagatgaagatgcgtacttgaacaaaaaggagcaacttttgccaaagacaattctgtcaccattcttaaggatgtagtctttcttcaccaaacgattaccattaataaaagttccgtttctgctcttatcgataacattaatcaaatttctttggaaattatccacatccatttgcagtagatgaaactcagcatggaaagtcgagatgtcaggctcactcaatataacgtcgcacgacctacttctaccgattgtagtaacgtttctatttgttatttccactttttgctcctttccgggtattaagttcaccagatggcccagacaagtgtattctgagctgggcttattacttcgttgctgtcttttgaatgaagagtcagttacatcaccagagtgctctcttttcgtggacaaactcatcttcactataattgccttttttactgtatgttaagcccctttacttgttactctcgactataaagggttctcatttcctcctttttcaacaatatctaataattttccaaaatcatttgaaaaataccatggaaataaaatggaaaaaagtaaacaaacgcgtcgcgtcacgtaatttttttcttttcacacacataccatcgtattactattttttctatggttatatgtcgtatgtatctatttatggtattcaggggcttctattccttatcttctaactcataaatgactttgccatcagtaatagggttatattctttgtttaggaactgtgagaactttgttaagttatttaagcctctgatttctccagcacataatggcattttaacgacatggaaatcttcgtacaattcgtcgatttggtccaagtacttcttttgcatcttccatcttgcctgacatctcttacagttgtgctcttgatcgttttcagcaaataataattggttgacaatgatggaattaacgtccatatcgtaggaaatcaattcctgaattagtctttcagtttcatataaggataagaattcactgatacaaacgcaaacaaaagtcgttaggtcaggatccgtgaattgttgtctgatggtctcgacattagcctttaactcgttcaattttccagagatatcgacattacctgcgcccataaaagagtttagcattgggcccaatttgttggtaatttcaccgaacttttccaaaagcttggataaagtatttggtagttgtagaaatcttaatgtgtggccagttggagcagtgtcaaaaataacagtatcgaaggtttcaccttcgccctgttcttgccttttaatgtgcttcatgacttccatgaaggataaagcttcgtcgataccagggatggaaccggtcaaatcagcaagagcaccaccttgaagcaagcttcctagatcgtcaccttgaccgtcacttccgttattgttagcgcgtgaaactgccatgtcgttcatatccttcaaagcagcggatggatcgatttccatacatgatagattattcatgcctgtcacctttctggcgtctttaccaaatttctcaccgaatgcatcacttaagttatgggcaggatcagtagagatcagtaggaactgtttgtttggttgactcaaagccatttggatagcaatggaacatgatgaagtagtcttaccaacaccacctttaccaccaacgaaaatccacttatgagtggtagaggtaattaaagagtgcaaattaggttccacggttaaatccataattacaatgtgatgatcttcttgttcttgtcgtacgttttcctaaacgctgcgttggcttccctcaacttgtttgaagttgccaccgttttatccattttcgcttttgaaaaaaaaaaaatggttgagaatccccagcactattaattagtactattgttacgaagatcttgtgataaaaaagggatgtaataatttgcattgaaccaacctgaattgagcaagtttatcatatagttacaatgtctgaacaggagtctgatgaagttaagcgtatgaaacaattggaagaggctagaaagagagtagaagaattgaagaaaaagaaaaataaaaagaataaaggtaagaagaataaaaatagcagtgccacaggctctataggatctgaaactcctgatttagagggcacaccaggcgaagagtccacacaggaggagactgtgaaagcaaattccaccaaaagtgaaaacaacgatcaaaatgacgtggatgaggagagtgaagaaaaagaaatagaacaggttaaatcagatccttcgggcacaacagaaaaagatattgaggaaataaatagtacttcatcaaatgtgggaaaggatgatgcagaaaacacaaaaaaagaggaagttcaagaagttataaaaaataacaacgatgagcaaacagcagatgccggaaagaccatagaaccacaagaggaaaagaaaattgtacaaactcaagaaggaaacgaaccttcaaatacatcagaagcagcagacgatttatttgccaatgacggcaatgaagaatctgactttctcaccacgattaaaaagcaaaaagaagaagatgagttgaccaaactaagggcggaaaatgagaaactcacacaggaaaataaacaactgaaatttttgaatatggaaaatgaaactactgtcgatgacctacaggatcaattgcaggaaaaagaagacatcattaatggtttacaaaacgatttgcaaaccgcaagggatgaattaattgccgcagtagaaaaattaaaattagcagaagctaaggcagcaagaaataccacagcaactcctattcaatttgcggatttcaacacttcaagcaataatctaactccctcacaatctgtaaccaattctggtacgcaggtggcccacgggaataatatggaagtggatcgcgttatgctgaacaaatggcgccagtggaacgtagacatgaccacttggagaagtattggttctggcccaataatggaattttgagaatgaatattttcgcgtatatattttaattaagggtttatatacataaaagatatatctaatgatctgatctgagtcccgactttttatatgtgctctatgcttgtattatgctcatttatctttacttggtttctcattttttagaggtggcaaaattggaaaatcccatcatttgactgacttttgattcactctcaatagaaggcttagtagccactttctttgctttctccacatctgtgtccaaaagccttttcctcttggactgagtctccatagaacgcacctctacaaaatcctttatcaagttatgatagcacaactcaaactcctcttgcggtacgtcatcattatctcttatatctataattaacggttcatcaaacaaattttcaaattttattgcatggaccttgtggttgagatgatcaatgtattgtaaagtgtctttgaaggttaggttacaaatatcgcagtaaaatccgaacttctttcccctcttgaaagacgataagctctctgtatttgctgttagtttccttttatttaggtcttttagcgagcccttgattaaatgatcgtaatttgtatatttggattttaaagcttgtaattcaatcggtgttagcgtagcctttaaggatcgatcgtcatagccgcttctagcctgctcagcatactcctctctatcccaagttcttctgccaaaattcgacattagctttctcgaatttttgtcagctaaggcttgtaggaacttctggttttgatgaactttcgcatcaactgttttctatttagcggcgcattcgattaaacttcttcctttcttaggagaaaaaaaagaaaaatcatacttatgtattttctgcattttataagtttatttaggaattcttactctggtacttgtgagtatacatacatatatatacatgtaaacctaatacaagacacttgccttttcaaatagttgatcgacgactttatttagttgcccgactaattccaatgcagagtcgtacgtggcatcctgattcggagtttcgtaaacgtaaagccaaccattaccttgatccagaacaccgtagaatatcttatctagtatcatttgggagagctttccttcaacttgttgagtatccagaccgattattttggaaatgtgggatatttccacacattcaaatggctcaataatcttacacaaattggactctaataacgtgtcgtataatgcattgaaatgggatcttgttagttcatcgcccattagttccttctcgtattgctttagcgccgtgttgaagtctaaaagcgatctgttgttataagcctcagcgacagctttcatggcatcaatgcctcgggactggtacgtttcctttgtgtattttgcgtttaggatgttttttacgtcatcaataaggttcagcatgatcttagacaatagcatgtatttcaacacttgacatgccttttcgtaggaattatgcgtagtcaaattgtggtagctttcaaaactttcgaagaaatacgaaaatgcagttttgtagtctttatcttcacagtgcaggataccactcatcaagtccagctccgcaactgtttgtgtaggacagtatatggagttagcggccgtccttgctgcagtcaacgaggccttggacttggctagattcctcagtttatggtaaactttactttccaatagatgtacatcaaccaaagagggcttgtcgtccagctttttgaactccctcaaaagatcgttaatcaatgctaatgagtccttgtactgtttcttttgataatgtaaggtggccaatttgatcgagagtgaatgcttcaaaaacacccttttttctctcttggcaaattcgatgcttttctcgcacacaaagatctgatcgtccaaggagtccggcacttgctcgaatttttcaatcaacgttttcaatacctttaccgttttggatttggcaaattgcatcatatactccgtagaatgaggaataaactcgcgcaatttgtcctttgcacccatagtcacgtataactgtcctaattccaatatgcttgtctcctgttcatttctacgcttgtcatccacactggcaccggcagcggcgctgctctgtgagctgtctttatccagcaggctcaaatagacttgttctgcctcattatactgtttttcattaaccagtctcctggcctcttctaatttcgaacctggcagagacatgaagttcctcgtttatagattaatcaccaattgtcctctttcagcgcttctgttagttggccttatttaacggatctttgcttcaattacgctttctaccaacatttgccacccttggaaccagaagagaatatacatcattcggggttgccctgcccatttatatcgtatattgtgatgatataccttttttttttttttcgctgcgttttttttctcgacacgtgtcgaagaagagtttggcgtttctaagcagatcttgattattttcgagcagcaaaacaagacaaacaggtgcattgttaaagcgaggtagtatcagaagagcctatcaagaaacagctaacagctacaagcacggtcatgtcggaagagaaaacgtacaaacgtgtagagcaggatgatcccgtgcccgaactggatatcaagcagggccccgtaagaccctttattgttaccgatccgagtgccgaattggcctcgttacgaaccatggtcactcttaaagagaagctgttagtggcctgtcttgctgtctttacagcggtcattagattgcatggcttggcatggcctgacagcgtggtgtttgatgaagtacatttcggtgggtttgcctcgcaatacattagggggacttacttcatggatgtgcatcctcctcttgcaaagatgttgtatgctggtgtggcatcgcttggtgggttccagggtgattttgacttcgaaaatattggtgacagctttccatctacgacgccatacgtgttgatgagatttttctctgcttctttgggggctcttactgttattttgatgtacatgactttacgttattctggtgttcgtatgtgggttgctttgatgagcgctatctgctttgccgttgaaaactcgtacgtcactatttctcgttacattctgttggacgccccattgatgtttttcattgcagctgcagtctactctttcaagaaatacgaaatgtaccctgccaactcgctcaatgcttacaagtccttgcttgctactggtattgctcttggtatggcatcttcatccaaatgggttggtcttttcacggttacatgggtgggtcttttatgtatctggagactatggttcatgattggggatttgactaagtcttccaagtccatcttcaaagtagcatttgccaaattggccttcttgttgggtgtgccttttgccctttatctggtcttcttttatatccacttccaatcattaactttggacggggatggcgcaagcttcttttcgcctgaatttagatctacactaaagaacaataagatcccccaaaatgtcgttgctgatgtcggcattggctccattatcagcttgcgtcatctctctaccatgggcggttatttgcattctcattcacacaattatccagctggttcggaacaacaacaaagcactttatatcctcacatggatgccaataacgattggttgttggaactttacaacgcacccggcgaatctttaacaacattccaaaacctaaccgatggtaccaaggtcagactattccacactgttacaagatgtagattacactctcatgaccataagccacccgtttcagaaagcagcgactggcagaaggaggtttcttgttatggttacagcggattcgacggtgatgctaatgatgactgggttgttgagattgataaaaagaattctgctcctggagttgcccaagaacgggtcatagctttggacacaaagtttagattgagacatgctatgacaggctgttatttgttttcccacgaagtcaagttgccagcttgggggttcgaacaacaagaagttacctgtgcctcctccggtagacatgatttaacattgtggtacgttgagaacaacagtaacccattgttaccagaagataccaagcgtatttcctataaacctgcaagcttcatttctaaatttattgaatcccataaaaagatgtggcatatcaataaaaatttggtcgaacctcatgtttatgaatcacaaccaacttcatggccattcttgctacgtggtataagttactggggtgaaaataacagaaacgtctatctattaggtaatgcgatcgtatggtgggctgtcaccgctttcatcggtattttcggattgattgttatcactgagctgttctcgtggcagttaggtaaaccaattttgaaggactccaaggttgttaacttccacgttcaggttattcactacttattgggttttgccgtccattatgctccatctttcttaatgcaacgtcaaatgtttttgcatcactacttacctgcttattatttcggtattcttgcccttggccacgccttggacataatagtttcttatgttttccgcagcaagagacaaatgggctacgcggtagtgatcactttccttgctgcttctgtgtatttcttcaagagcttcagtccaattatttacggtacaccatggactcaagaattgtgtcaaaaatcgcagtggttgtctggttgggactacaattgtaacacatacttttcttcattagaagagtacaaaaaccaaaccttgactaaacgtgaatctcaacctgccgccactagtacagttgaagaaatcactatagaaggggacggtccgtcgtatgaagatctcatgaacgaggatggcaagaaaatctttaaagacacagaaggtaatgaactagatccagaagttgtcaaaaaaatgttggaagaggagggagctaacattttaaaagtagaaaaaagggctgttttggaataaatttcccagtactctccacatttttatgtaaagtcttctataagctctcgagcgtataattaaaaacgaaaatagacaaaaaaaacatcatgaataaaaaaaatgtcttgaagctgactatattgtccatctgcgtttagagacacgtattctatttcgctcaaataagtatgatctgcaagtagtttcagtggtattatcatttcgcaccgttttttttccaagaactcgtttacgtgccgcgaaaagtctatcgaataggcattcgagaacaatagaaaaggaacagaagcgtagtacatattatgcatagacccgtttcttttcttctttttcgaaaatattcttattgatttaacaattaagcaggtgtgtaagatcataactgctttaaagatgaataaagagcatttgctgaaggtggatcccatccccgatgtgactattaaacgcggccctttgaggtcttttctcataacaaaaccctgtgataatttgagttcattacgaacagttacttcatctaaggaaaagcttctagttggctgtttgctgatatttactgccatcgtaaggctacacaatatctccctgccaaatagtgttgtttttggtgaaaatgaagttggtacatttgtttctcaatacgtgaacaacatattcttcaccgatgttcatcctcctttagtggcaatgctatatgcaaccgtgtcctctgtttttggttataaagggcttttcaattatgggaacattggtactgaatacacggcaaacgttccatacgtcgcgatgaggttcttttctgctactttgggcatcgtgtccgttttggtattatacttaacgttacgagtttctggcgtgaaaattgcggtagctgccatttgtgcagtatgttttgcaattgaaaactcctttgtaacgttgtctcgtttcaccttgatagagggaccctttgtttttttcatggcatgtgcagtttatttctttagaagatcggaactttatttgccaaattcatgtaaagcaaacaagtcattacttgctgcgagcattgcattgggatttgcagtttcttcaaaatgggctggcctcttcaccatcgcatgggctggtattattgtcctttggagagtatggttcatgattggtgatttgtcaagacccattggttcttctatcaaatatatggcgttccagtttacctgtctattagctattcctgccttcatctattttctcattttcagcgtgcatattaagacattaaacgtgaatggtattagtagtagcttttttcccgctgagtttagaaaaactttaaaatacaacaacgttattaaagagactgtggcagaagttgcagtgggttccgctgtttcactgaatcatgttggaacggcaggtggttacttgcattctcatcttcacaattatccggctggttccatgcaacaacaagttactttgtatcctcacatcgaccaaaataacaaatggattattgagctggctgaacatccaaatgaaaatgtcacaagtttccaaaatttaaccgacggtaccataattaaattaagacagcttaagaacggctgcaggttacactcacatgaccacaaacctccagtttctcaaaatgcggattggcaaaaagaggtgtcatgttatggatacgagggcttcgaaggtgatataaatgatgattggataattgaaatcgataaaaagagatcagagccgggacctgcccaggaacatattagggctattgaaaccaaatttaggctgaagcattatctaactggttgttacttattttcacatcctgaaaagctacctgagtggggattcgggcagcaggaagttacgtgtgcatactttgcaagggaagacttaacttcatggtatattgaagaaaacgaaaacgaaatttctttgccaaatccagagaaggtttcttataagaaaatgagcttttggcagaagtttgttgctatccacaagttcatgttctaccttaacaattatatggatactagtcatgcctactcatctgaaccaaagacttggcctcttatgttgcgtggtattgatttttggaatgaaaatggcagagaggtgtactttttaggtaacgctgttttgtggtggtctgtcacagcatttatttgcacgttcatcattggagtggctgttgagcttcttgcttggaaattaggtgtgaatattctacgggataagcacatcataaatttccactatcaggtctttcagtacttattaggctttgccgcccactatttcccttacttctttgtggggcaaaagttatttttgtacgattatttgccggcctattattttggtatcctagcatttggtcatgctttagacctgatttcaacctatatttctaacaaaagaaacaatactggatatatagtggtggctattttcatggttgtatgtttctatttcttcagcgagcattctccacttatttatgctactggatggtcgagtaacctgtgtaagaggtccaagtggttaggaagctgggacttttattgcaattcactattactatccgatagccactatgaattaaacgctgaatcatgatccatccacccgtattcagattggacattcgtttagcaaaagatttaaaaactacatttgagctaaactgcgggaaagatctacgtacatatggaaaagaaccagatgtatatgaaaaaagagttcataaccggtcacaatgcaacactttcctatcttgttctttcgttgaatttcactaaacaactaacgaataccaaaaaaatgatccgtattaagtaatgtatatacatatatattgtcaaatacaacaagatatttaataaacaaagaatagatgaattaggattgaaccggtaaaaggaaagctgtgaacatggtatttctcttatcgggcttttcaagatcaccactgagtggcattttaagcacatgaggagatgaacgtaggcagatcaaaacattcagccgatgataaagactacaacagctatttgattgtctttgcataatcgccctaaattggaggcttctacaaaacaactaattacatattcttacttcctcgcccgtgcaaaaggataatatatctctcatttgaaaaaatagccatacttaacgttaatgtttaacttacgggttggcatacctcttctttaatacaaatcaaaaaacgtagctttcttaccaccctaaaacaatggcaaatactggctgtttatcaccaggtgcatttttatcaaaggttccagaatttttccagactgcgaatgaaaaacatataactgtgcgtctaacggccaaaagactcatagaacacgatcctgtggaagggaatcttgaatttgattctaccaaccatcctgactatgatgtatctaaaaaggcttctgaaatttcagttagctcaagatctgacagagaatacccactattaatcagaatgtcttatggctcgcatgacaagaaaacaaaatgctcaacagtggtaaaagcaagtgagttagatcaattttggcaagagtattcatctgtatttaaggggggcatgcagaatttgatcaagaagaagaaaaagaagagtaagaacggtaccatcagtaagacaggaaagaaaaacaaggtagcgaagaaaaactgatgcacgtgacacttgagtcaaaaggcatgtgcgcctcttgttatctttggatgtgtagattaaaggatggcaacgtagatataaaagattaattgcataaagttgtgtagatataaatttaactaaactttagaataaacgttttgagatgactatttttgaaattcctttcattcgtccaggcgttccattacaatatttcctgatggatatatgccgctaacgtcagatattttggtagataaatcaagctctcttcttggtaccggcgtgatcaatttgaagctatactggtgctgataattagcaggttggtatacgggtaaagtatcgttttctgagttcaacatgtcatgcaactgtaattctacgaaggcatatatctcctccgttggtagagatgcgtcaaactttctcactaatctctgcccattttctagtctgatcgcaactttgcttgcatctttatcagaagagggttcgggttttagttggctttttctccacaatagccattggttttctattctttggtgctctctttccatttgttctctttgggtctgttccaatctttctgattctctttgttgatcacgtcttaaggaatcctggtatcttgaatcctgttgttgtcttattaatctctgcatttcaatattttgtctttgctgacgcaattgaattaatcgagaataattcttggagaatatggcctccaaatcttgggctttgtagttagaaatagaaccttcaactcttgctattaactctatttttttctcagcctttaaagaaattattccaagtaggggatattgcctaatttttaatgcattggaaacttgcaacccctcggatgtagtaacgtcaccataccatagtaatacctggtacttccttatcatgttaacaaaggcttctgagcacaatattttattaacgtaatccatatgattatccaacaatgggtcatgtaaataaatgactccaaatttcacttgttcgctacaagcatccaataattcagtgtaactattttgcataatgcttttggaaaatgttccattttcagggttgtataaagaaccaaaactaaactggaccccactgctctcattgttgctcgtactgtcagtattgctgccatcatcattattcccgttaccttcagaacacgttacagcttgagcttcgttttctagattttctaaaagacggtgtaattgggaactgtggtctagtaaacggttgtgcttcctctggtagaatccgtgaagtcttaatagaggttttaaaagacgtgaacttcggacaatgaaattcaataaataataaagaactattaggggagcttgaaataaaaaatggagtattgattttaagcgtccatcccggctctgtgtgggttcatttgtattgctgttttgatcttctgtccttccattcaaatcagcaggtggttcttctctaaaagcacctgggattcgaataaaggaatcatcattatttccaaaagtatgcctaaatatatccatgtttaaagggtatgtttaaatcgcagtcaagccgattgatgaggtacaacaaaatttgggagtacgattgcccgctgtttttgaacttactctcactttttgcttcgtatgtaattaagcaaggatgtgttacaataagatttcgctttgttattatcgttttaaaagcggtcgccgaagtgtcgaataaaggacaatgataacgtaaagagaaagaaattggaaagagactgaccgctaaggagattgaatacatatatataatagtatgtggttaacttggagaagataaattggatttaaagtagtggataatttttcttacattttctattggtaaaccatagacagggttgacatcagtaagtttcgatgatccaattaggcggtctggagtacacttaatattatgtggagaatcattaggagtgcaactgtatgaactttccgcaacagccagtcctaataggcaataatttgtatggtaaaagtctgagtgggcccctggtttatctctcaaaccaggttgctctttttcttggcaacagtacaatatgtagtcccgaagagcatgtttgttgaagcattggccatatccaaaagcttcaagaatggcagccgaacctccaacccaaaaactatagcaaccgtcaacaagtttgttgctccttccgcaaaatcctcgttcttcttgcaattgacgagcactagaccattctaaaagcttttcaacatttatttggtccatggaccttaaaattgctagactagctgtagcacagaaagtatagcctccgtgtgcctcatctacgtgaggacaactgccgaatccaccttcataattttgacaatttttcaaatagtttaacacaccttctgtaagctcttctgtaagaatatttaataaggttgctatgctcaaggcacagtatatacctcttgtatccacttctccgacttctaaacaggtcttgaatcctccattaggctctttcaacgatatcagccattggtaaattccttttcgatcaattctgtcccagcatccatctatgttatcgcaaagggagagagcattaattgcagcataagtgctggccaaatgagataattggccaggacctccaccaaagggtcctcctgaaggactaatagtaaagagcttatctacaatttttcttttggtgtcatctgaaagccagtctctgtccattaccttcaatgagttagcaatccaatatagcatccacggttgtgaagcatctagtgctgtcatttgtggaggtaacgatatctcaaaagcgacatccaagtacattttgtgaaactctttcgtgagagcaggttctatattcttttcatcatcgtatatctctaatacactttgtagtactttgtatcgtgcttctgtagtgtcggtttctagttccttcatcaatggttggattgctttacttgaatctacatgcgctatatcgacgactctttccataactggtctctttcttcctaataaggcagtatttataaatttagccctagctatggaccttcctactctctgtcgcatacgctttgattgcctatagctttacaagcactgcagttgtttctgcataagaacggcgatgatatggacccttgcttggtttatcctagccactttcgcgtgtttcagtttcaagctttcctaatcaggcaacagcttatacgaaaagattaataagttacaatgttaaacagtttcgcttcaagacctctaacgttagccagaaataataagaataggtggattaagttacaagtgtttttgtcctcctacttaatcagaacagagcacgggaatagtgatctctttcaatagcgaaaggagggaaaaatagccctgcaatatataaaggaagaagttaacaccgtattaaaaggggtgaggccgttgggacaagtggtagtttccttaaagtctggtttgattgacaatatttagaagttagtgaaacgaacaacctaaaaaactttgttgtgcagtagagagctttacatttaccttcggcagtaaaatgggttcaaatgatttgataaatgaagcatatgacgactcggaagtagttggtgaggaaagagaatcaaaatctgcatggatgaagaggtggtatcagctacttacttctcctttagacttgcagttggtaataaatgaaaagttagaaatgatcaactgggatgcttatgctaaaagtctagctaagccattagggaattttttaacaatacttttttttatcataagactcttgcaggacaatttgatcaagcccaactattacaaactaaacgtcaagtctggcgctttcgatctttctaaatccaataaattaaaagagtttgattatctatgggagatatcatccagctttcaaaacaataatcaattttatgcatttcaatcttggtattttgttaccttaaggtttttgaataatcttttcaggtttactattttcatactgctgtccctgaacctgtacgtaagctgtaaattcatgtttggatactttaagacttacaatctcttccatttgaaaaaagagttcaactccccaaacctcactaaacacaacttgaaggatctaagcaaagaatactatgaagatatttataagcagtccttgtggtctatgttgaagcattttttcagaggatctcgtgatgacggtcctcatgttaatcaaaatgaagatgagatattttttcagttaagaaaatggatccccactaacttcatgattaatctttttgtgtctttttcaccaacggcaattgtttttttaagcttttctgatgtttcgtttacttcagcaattgctatagtattccatcaatatattctggattatatcataactaagagatttcaaagaagcgtggacgacgacttgattttatcaagtgcagctttgcaagaatatgaggacaagcatataatggcacgaattaaccaatgcagcaatatagatactctatcatctgcaatgggtactagatctaaaacaccgagaatattcaccactcactccctatgtggcgaagaaatcagagaggtttataattatgaaaaaagggaatttgaggcattaccgaaaatgacagaaagtgtgccaggatcccgtgaaaccagaataaaggattatggaggcatttctcaagtatctgaccatcaaagtcatcccattggttttcattattctcctagaatgtccccatattatagggataaagttttggataacaatttggctcaatcatcgtcaaatgaaaatttagagaagggcggagcttacctgccgaatcaagaccaaaatagaccatcgaaatccctgagcccattgagaaaaacgcctttaagcgcacgacagaaaaggtttgaaggctcagagttcaatgtattgaataagaatgatattaattccattcttcgctctccaaagaaaaagaagaactatcacaaaagataacgtttcttaattatgtctaagtatatacagttacgtaaaaatcaataaacaaaagtaaaacaatgctgtttgaaaagttatcaaaataataaatgtatgaagtattgtaaatgttcatgaataattagctggacgatttctgttataggtcattccaaccaaataaccaattactcagtttgtgcgtaaaaccagcaggttcattatttctgtatttcgcttcttgctgacgcattttcgattctaggtttcgcaacagattaggaatattcgaattcggtcctgcattttgcatgaatggcaatttgccatctattacatccagccgcttattcggagaatttgctactattggacttgaaatatttgttggattaccagcatgaccggcaggagtattatcgtcttccctcagaagagtgccatcagttattattacgtttggtggggatggtgtattagatgtcgacgatgtggaggaattttgatacatagaaacgttgaattctccaatgtcgtcgacattatcaattttgcagccagctaattgctccaccgcattttttgaatatgggatgcaaccaatcaaagaaccgcgaaatatggttccattttcctgcagtgctctcaaagcagaagatggagaattataagtgagtttgacccaactttcaccagtaaatattggatattttttgttattcgactcattatttctgccttttaaagtaatagatttattaacagtagaatcgttttcatcacagcctgtatcatgattatggaatattctgaaggtgttggggttaatcccgcgacccaatcgcaatacttgaaagtcttccataatatgaccgaaatgggagaagtgttcaatcaattcattggaaattgattcaggatagccaaatacgataattgcgctcaaactagaagacttggaagatgtttcatggactttattgtttgtttcggcggtgttgtaattattatctaaatggttctgttcaatgtttgctattctaacataagagtctttatcaaaaacatttggagtatttttggaatcataagctgacctatttgttttcttcgccgtgtatttgtcggtaacaaactgagttgttaatgatggaatagaaccgaattcatcctcgcgttgccaatcctgtaaagtaacggagggtggaatatcgttaaaatttgacaacagagaattgatgtcattatttgccgcagacttatttctttcattatgcttggaatcttgattttgcttactgaaatttctcatagtagcgttcatagaagatgaatcatcattctggttgatgtcagaagaagaattttgctttgttgtcttccttcttatcaccgtatgaggagtgaatctctttttaggattattcacccagctaggattattcccttggccatgttggcttatgttatttgtgccgtttttaatgttgttgttgttgatgctattgttaccgatattactactatagttattggcgtttacagtattggaaagtgagtttccaaatcgtaaagaacttgcatcggatgatccattgaattgcaagtgttgctgctgttgttgtggttgcggttgcggttgtggctgcaactgtgattgcgattgaaacatctgggttgtctgtggtgcttgcgacgtgaggttagtaaatccaccgttattattgcctgaacgtattccaaacattttaatttgccgttccttgttttcaggttacagagaaaaaaaaaaaaagagagcgaataaaaaacttaaatagatagggaaacgatatgtctaccttatcgggaaataaactatgcagaggtatgtgtgtgatattcacaaacctttcttctttcataagtactctccttcgaacaaaatttttctagcatcatttttttatgtatggccctacacaaagcgtcttccgggtagtgtagtagctgtcttgctggcgttagttgtccggttattcttcattagccgatcataatcctctctcatcttgacatatcccagatgaatcttccccaagaagtggtcagcaagccttctgtctgtatctaaacgcgataggtatgccccacacacctcgcaaacctgtaacttttgctgggcgctctggcccacgttttctgtaatgtttcgtacacgttttgcaacttctttccttttactaatcagttcttgtaatttgactgactgtagcatacccatactgacttcatctgcacgaattaaagaatcaatctcttgtcccattaggcctatccgcacgtccaagacatctagttcttcggtaacctgctgaatcttcattcgttcctcagcggtgtgttttagattttgtagtgctacggatatctggccattacactcattaacaaaccgagatagaatggccagatattctctttcgaattcgggaaacgttttgccctgcttgacctctctctcgtactgaattttatgcttggtaagatgcatctgcgggcattttcccaggctctgcttggtgccctgaaacaggtcgtaggggcactcgccaacaaggtatgacttgcagatcttgggatcgtgtagtccgaggtctcttttttgatgcgaatacctgttgtggcggaaactgaagtccctgcccatcagctgttcgacgagtttgcgttgttctgcggcaggcgttgacatagttgacattctgacggtagttggcagctttctgctgggagtgtagagccttttgtagtataactttttgttcttttctttcttctctaatgcctgaggcttcggcggttattcgggtaatacattaaggaagttgccatgatgtggaagaatacgactagtcagttagcgatggccagctcctttacctaaatcatgtggcctatcttcagatagcatactaccaccaaccatcaatacctcaatggctttcaacaagtacccttcgtcgggttttcagcttttttcctactttgctggatgctttgtgaagatcaggaagaaattttatcggaaaaacctcactaggagaaactatataaaagaagggtcagactgaaaatgacgccgtaataaactcgtggtagtagataaagcaaacaatgttgattactgagacctttcatgatgtgcagacatcatacggcaccactctgcgtatatacgtatattctcctaagattgcaggctatccacaagctaagtttcctggggtgattctgtacagtgaaatttaccaagtgacgggtccggttcgtcgttttggtcaaagaattgcgtctgaaggttacgttgtggtggcacctgccatataccacaactttatgggccctgaagcgttgccctatgacgtgcagggtaccgatattggtaacgagtacaagatcaagaagccgttagaatcatacgatgaggacaacaaactgtgttgcgatctacttttccagttaccccaattcgatggtaagagaattggttccacaggaatgtgtttaggtggccatttggcttttagagcgctcctggacaaaagggttacctgcgcaacctgcttcttccctaccgacatccattccagaaccttaggtcttggccagaacgataactctttggaacgtgtttcgaaggagttgggtaataaccaagaaatggttttgatcttcggaactgcggacacccatgtcgacccgcaaggccgcgatctaatcagaaagaccctcagagaccacggagtaaagtttacgttcttggaaatcctggctgcccagcatgcgttcatccgtgacgagttcagcaagggcaggttcgactccgctatcactcaaagttgtctcggcttcttgttcgagcagttcaacagaaaattgagaatcgatttgggtgaatttgtcgatgacaatacacctttggagcacgtttgttaagatcttcactctgtacacgctatatactaaataacaataagaaaaagaaaaagaagcacaatataggaaagcgttctaattaactaaagaaaaaaaaaaaataaaaaaaaaataaaaaaaaggtaactaaaaaggacaaaaaacataacagctgtttataaagtactttatacgtaagaaactactggcactattcattccaataaaaggacaggtataaagtgtctgcttatcttctcgtcttttcggcttttaacttctcaagcttttcagcctctcttctagcatctgcggcggcctgcttttgtctcaagatttcggcgtctgactccattcttttcttaggatcaccactctttttctggttcttagccatgtccttttgttttttcaagtttttttgtcttgccaagtctctttgattacctctagccattgttaaagatgtatcgtcttgcgacgtaatttgttgctctgtgtagtattgatcttgttggtattgctagaaatgcttcagcaatactgtataaaatatggaaacgttgccatggcaagacaaaagaagtgatcttgagtgaaataatagagcccggatggccgggtaaattcaaccgctcgtaccgtttataatacgcataaacgccgaaaatgtctctattttagtcattccccagagtgcggtattgcgtacacctgtcatgcgttccttagtgccgatagatatactaatatcgatgcgtcacagtagcagatcatctctgacacttgtttccccatttttttttttcattttttaaagggtttctctacagcctacaggcctcccctaataagtcagcccctccctttggagtgcgctgttgacctgcgtatataagaggtatatcagtgccagtaggtaaacccatcttgcggggattgtaccaggaacatagtagaaagacaaaaacaaccaccgtacttgccattcgtatagatgctgcccagacttggttttgcgaggactgctaggtccatacaccgtttcaagatgacccagatctctaaaccttttttccattccactgaagttggtaagcccggaccacagcagaagctatcgaaatcttacactgcggtattcaagaaatggtttgtcagaggtttaaagttaaccttttacacgacgttggccggcacattgtatgtgtcatacgagctgtacaaagaatcgaacccacccaaacaggttccccaatcgaccgcttttgctaatggtttgaaaaagaaggagctggttattttgggtacaggctggggcgccatatctcttttgaagaaattagacacgtctttgtataacgtgaccgtggtgtcgccaagaagcttctttttgttcacaccgttattaccctcaacgcctgtgggtacgatagagatgaagtctattgtcgaaccggttagatcgatcgctagaagaacgcctggagaagttcactacattgaggcggaagcgttggacgttgatccaaaggccaaaaaagtaatggtgcaatcggtgtcagaggacgaatatttcgtttcgagcttaagttacgattatcttgttgttagtgtaggcgctaaaaccactacttttaacattcccggggtctatggcaatgctaacttcttgaaagagattgaagatgctcaaaatattcgtatgaagttaatgaaaaccatagaacaggcaagttcatttcctgtgaacgatccggaaaggaagcgattattaacgttcgtggttgttggagggggccctacgggggttgaatttgccgccgaactgcaagattacatcaatcaagatttgaggaagtggatgcccgacttaagtaaagaaatgaaggttatcttaattgaagccctgcctaatatcctaaacatgttcgataagacgttgatcaagtatgccgaggacctttttgccagagatgaaattgacttgcaagtgaatactgccgtgaaagtcgtagagccaacctatatacgcactctgcaaaacggccaaacaaacacggatatcgaatacgggatgctggtttgggccacgggaaatgaaccaatcgatttttcaaagacactgatgagtagaataccggagcaaactaataggcgtggtctgttaattaatgacaagttggagcttctcggttctgagaattcgatttatgcaattggtgattgtaccgcacacacgggtttctttcccacggcacaagttgcacatcaggaaggcgaatacttggccaagatcttggataaaaaattacagatagaacaattggaatgggacatgctcaacagtaccgatgaaactgaggtatcacgtctacaaaaagaggttaatttgaggaaatctaagttggataagttcaactacaagcatatgggtgcccttgcgtacatcggctctgaaaccgcaattgcagatttgcatatgggcgactcatcataccagttgaaaggtatgtttgccttcttgttttggaaatccgcttatttggccatgtgtctctctatcaggaataggattttaattgccatggactggaccaaagtttactttcttggaagggattcctccgtgtagtccttgttttatatattcattgttccaattcaaattgtttactatcatttacgtattataaccagtatttccctttattggtcatggaagattcgcgttacccttactcgttaacagtgatattatttgtatatgtgatgaaaatttaagaaaaaaatagtcgacaacacgccgaataaacaaagggtttcttcaatacctgatatagtagctagagggcagaagtttgaggtgatatctttctgagtgttgttatttttgtaagtcgtaacacggaactgtttgcctgttggaattttacgttactattctcatcggtataactagcttatattcactttggcaataggttaaaaaaagctcgttcatttttttaaaaacagcaacgatgtcacacgaaggtgaagaagatttattggagtactccgataacgaacaagaaattcaaattgatgcctctaaggccgctgaagctggagaaactggcgccgccacttctgcaactgaaggtgataataataacaacactgcagctggcgacaagaaaggttcctatgttggtatccattccaccggtttcaaagatttcttgctaaagccagaactatcaagagccatcattgactgtggttttgaacatccttctgaggtccagcaacataccattcctcagtcaattcatggtaccgatgtcttgtgtcaagcaaagtctggtttaggtaagacagctgtctttgtcttatccactctgcaacaattggaccctgttccaggtgaagttgccgttgttgtcatttgtaatgctagagaactggcctatcaaattcgtaacgagtatttgagattttccaaatatatgccagacgttaagacagcagtcttttacggtggtactccaatttctaaggatgctgaacttttaaagaataaagatactgctcctcacattgttgttgcaactccaggtcgtttaaaagcgttagtgagagaaaaatacattgatttgtcacacgtcaagaactttgtcatagatgaatgtgataaggttttagaagaattagacatgagaagagatgtgcaagaaattttcagagctactccaagagacaaacaagtcatgatgttttcagccacactttctcaagaaattagaccaatttgtagacgcttcttacagaatccattggaaattttcgtcgatgatgaagctaagctaaccttgcacgggttgcaacaatattatatcaaattagaagaacgtgaaaagaaccgtaaattggctcaattattagatgatttggagttcaatcaagtcattattttcgttaaatctaccacaagagctaatgagttgaccaaactattaaacgcctctaactttccggctatcaccgttcatggtcatatgaaacaagaagaacgtattgctcgttacaaggctttcaaagattttgaaaaacgtatttgcgtgtccacagatgtttttggtagaggtatcgatattgaacgtattaatttagccatcaattacgatttgactaatgaagctgaccaatatttacatcgtgtcggtagagctggtagatttggtactaagggtttggctatttcattcgtttcttcaaaggaagatgaggaagtcttggctaagatccaagagcgtttcgatgtcaaaatcgctgaattcccagaagaaggcattgatccgtccacttatttgaataattaataaaggaaaaaagatacgtttttatatagattatataaagattttgtattattcaaacgaacaaaacaaacaaaaaaggggaagtggaaaaaaattagcagttatagcgaaagattgagtttttgttggaaaatgaacgtagtgtagtcatttcgtgaacgcacaagacaattctattgggcatcacatggcaaagcatgataaggaaatgaagttttgggaatgattctaaattaacgttttacccgttataggaagatatacagtatatgtaagtaaaaagttttttaatacaatagatgtgcaaagaaaagtgaagagatttctggaaaaaatcttgaaattttcttaacggtaagatttttggaatctagaacgagcacccttaccaccgaatttctttggttctggtcttctagaatcagcgatcaacaaagttctgtcgtaagaggtgaaggccttcttcaattcgttcttggattgttcgtcaacgtacttttggtggtaagcgactaaacccttagcaatagcttgtctgatggcgtagacttgagaaacatgaccaccaccagtgactctaactctgatatcgatgttggagaacttgtccaaaccaaccaacaataatggttcgtagaccttgaatcttaggatttctggttcaaccaaagtgattggagaaccgttgaccttaatcaaacccttaccggccttgacgtgggcaacagcggtagctgatttcttcttaccaaaagtctgttataaaaccaaaaatgaaaaacatttcgtgtcacatgttagtaaaacagaaattcaaaatcctcaaaaatattatgaactgtgtaaaagggtgaaacaagtgaggtaccctggcacttcctctttggagcattctgttcaaaattcattgcaaggggagcgaatgaataaataagaccgcaaaagacgctcattactttactccacagagaaattaagtataatattttcccacacaatttattggttatttctactcggtctttaacgtgtgaaatggtgatccgttgttctaaaactatgattcgcatctagtgcttgccccacccgtcttattcaggtgatatggttcttaaattgaaattatctcactgcatggtttcaatatccctcacaaattcgtgacatcgtttaaattatttaacatacttggacacttgggacggcagacatcttgttgcttattctcttgctgtatttttcgaaacactgctaaataaaaaggtatatattaaatagtctactgcgtaacctatacattttacatggcatttacttttgactttgccagtgttactctctgcgctaggataatattcggtggtataggctcacgcggcctggccggaacgaactgctaccagttctgtttccctcagctagagggaaacagagagaatttccgcccaggtcaaaggccacagcatccttctagaggaggagcgacaacctaaggaaaattcagtttttcctagatcgcatacatttttcaaccactttttttcacaatgcattatttttcaacatgtatgggtgttttttctgaatatcagactcttttatggagtaaaacaagctattaatatgtgacccatacatttcctgttacatccttacatatatgcaggcaattttttgtagttagaaaatttaatttttttctagtcggaataatcacagtagaggtgtggaaatcttggaaaatttgaaatgatcggatattagctactaatccatttaagcttgcagcattctgttcgaaggggtttgagaaaagcatagtacagcacagcaggaatcgtacacaatgggtatgtctactataaaataattcaaatcacttttgtcatttcatagaccaaagaagctcgcttgttaccttagaggattatactagtgcacaaaggcatgcataatacaacacacgttattgatgaacctagagaggctaaagttattttctaataaatcatgagatttttctcctttttacaataactgagcagtcatagtaatggccaagcaaattcgagacaggacctttgtaccactatttgctgaactcattgttagagtcttcttagataatatgataaatttggtgtctaattgaaacgtccacttttctgtatactaacaatttttaaaatgggatctaccaattgaattatatcagccatttccaagaatttaccaatcttaaagaatcatttcagaaagcactggcaagaacgtgttaaagtgcacttcgaccaagctggtaagaaggtttctagacgtaatgctagagctaccagagccgctaagattgctccaagacctctagatctcttgagacctgttgttagagccccaactgttaagtataacagaaaggtcagagctggcagaggtttcaccttggctgaagttaaggccgctggtttgactgctgcttatgccagaactatcggtatcgccgttgaccacagacgtcaaaacagaaaccaagaaatctttgatgctaacgttcaaagattaaaggaataccaatctaagattattgttttcccaagaaatggtaaggccccagaagctgaacaagttttgtctgctgctgctactttcccaattgctcaaccagctaccgatgttgaagctagagctgtccaagacaatggtgaatctgctttcagaaccttgagattagccagatctgagaagaaattcagaggtatcagagaaaagagagctagagaaaaggctgaagctgaagctgaaaagaagaaatagatctaaaaacttcatcaaagaatttttcatccacaatttttgtattttccttcttttttatctgttcaatttcataaataatatatatgtacaatgtataaacgggaagccatcacttataatttatcatttccttaactttatagtctgggtgagaatatggttgacagtatttttacaagttagcgcagttttcttgatatgatggaacattattgtattagtagtagtcaggtttgcaggcttttccttcgagcacaacgtggcattatatatagcatagaagagatgcgaaagatggtattgaacaaaaagaaagtactgtcttattgtattaaaagcgactatatagaaaaattataaaaaattttaaatgttagaatatgcaatttcttctaaacagtgcggcacttctaatcaaataaaccgaaacccatgtcgtcatcggattcttctttagcttcttcttcttccttttcagcttcggcttcaccggcttcaccaccagcgacaccaccagcgacaccagctggggcagcagcaccagcgctgaagttgaccaataagtccttcaagttttggccgtccaaagccttagcaaaaatatcagcccagatattttcaactgggacattggcagcgttagtcaaagtcaacaacttttcagaagagatttcgatttcagagtcagccaaaatcaaggcggcgtaagacaaagcggattcagtagacatttcttcttgttattttagagataatcggtttaagctgttgtattggacaaagcggactatttctttattcttttgatttcttttactaaaaattattcagaacagaagagatcgcaaactttataaagatatttttttcaaataccatgtaaaggcattctttaaaaaatgaaaaaaaaaaaatcattacaaagttgcgtggtatcatcttacgatattcgtacctcacgatatgtagcagacatagatgaggctacagggttaaggcttcttttaaatgaagtattagacaagatactagagtttaataagatcacgtatggtaatgttatttcttgctgtgacaattttagaaacagaaggcatgtgagttttcatattacattaattaaatgaaatttttataagctaggctactgttcagcgaataaatattttcaagccagttttatgaggcaggaaacgtcgcattcgagcggtaatcatgagggtccctggtagtagggcggagagatcagatcagtatccaacttgatttttttttagaagtggttggaattctggagttggcgtatttactgcgctagaattttcgttctcctcttgcacttgtttgctctgttctttttctaccacccacctgtcaagcagagcctgtggaacatcccttggtggtagcataatctctatcatccgaattttgtcattggtcgcaaagtttgggtcactgatcatggatctgaattctccaacagtaataatttttttcgtttcgtagttcgtgcaaccaaatactcgcaataatcccaagtagttccaaggttggatatcgtaataactagcatctgacctgtgatgcaaaaacctgtccacagagtaaccttggttattcatcacaaaaatataaggtgtcaatccccacttaacaattgtggataattcttgaactgtcaattggaaagcaccgtcacccataaacagaataactctatgtttagttgcggggaatttatccttgtttatctcttgaacagcaaattctgccccaagacacgcccccattgtatatccgacagatccccaaagagcttgcgaaatacctagtgtatttaccggaaatctggtctggttaactccaaatgcagaagcaccagtttctgttatgattatgtcacctggttggaaccaatgggatatttcattccagacccattcttgtctcaagaggacatttcctgctgggtaaggtcttggaaccatcatactgggttgttcgcttggttggtaagacagtttagattcatcaagatttgctaatattttctgtagtagtaatttaatgctcaagtcaggatatgtggcatttttcaatttcacagatgtagaatatagtagcgcacaattcttagttttatattggaagtggaaagttgacgtgctgaattcggagagcatgcaaccaatgacgatgataaaatcggcaaaatcaactacttctcttacttctggggctgatatcgagcccgtgaatacgcccccaaattgcgggtctgtttcgtttactgtacccttacccataggtgtaacaaaaactggaaatttaagcctattacaaagctctttagtctcctcgattaaattctgtcgactagtacatgcatctacgatgattgccggattctggcttttgtatataaaactcaatattcgagaaataacttctttctctacgtctgggtcgtttttatgcaattgtaaatccagaggtgtattaagccttgctgattcaatcgggagatttacctggttgacaggcatgcccatgtatactggcctctgttctatccaagcctttttgatgcacttatcgacttcgtcggcacataattcagagtcaataatcaatgttgtatagcatgctacatcactggctattctatgaaataccgtgaaatcaccattgcccagagtatgatgcagtagtagttgtttcgtttgtgcacttgttggcggcatacccactatgtgaagtattcctacatgttcagcgtaagatccggccacgccattgattgccgataattcgcctacaccaaaggttgttatgagacatcccaagccttttagtcgtgagtatccatctgctgcgtaggcagcatttaactcattagaattaccggcccatcgtaagttcggaatgttgtatagtttatccagcaacggcatgctaaattctccggagagtccaaatatggtatgtatgttcagctggttgagccgatggaaaagataatctgatattgctatacacttcggcagtgcatatctctgtgtatagctagaattcatcttcagaatgacgacggtgcgttttagtagttatgttctttcaaaccttttttttttcgttttattatattttactcttttctacacaatatcgataatgaattacgaatttggtgcttaccaaaaggttcaaagattactatgccgtaaagtatgaagaaagggaaatttgttcaatgcatcgcaagtttcatcaatttttcttctatgtgagtgcttttagcaactgtttgcaataaagaaacataggagttcttacagttgccaaggttctgcatatgcagtcatacgcttgtggccggtgaaaatttgggcgaccgctgcctagaaaagcagcaagtgaaattaaatgaaggaaagaggacggtcgttatacgttaggttaactgcatacgctgtgtatctgtgtgcagaagacaaatgcatattatgtaatagtaatgatacaatagactaagaaatttgaaggatgagatatatcacaaagacgatgaaggtgcagaaacaaaatgtttcaaccgttcttcaatggcgggccgttccacaagtggaacatggcccaactcagtttccacgtcgaagtcaaatatacgcaggttttgtgcttttacgtaagtgtcggtatcacaacgtttggtttcgtcaaaatagcttgataatagacattgtagaggtaccaatctttcgcaagggtgatacttcagagtttttgttaacaagtcaagagtatcgggatcttcggctttgaatatttcagccaaagtaatgggcttgatattggggaaaacatggtcttcataatttgggttcattcctgaaatttcatcctttgtgggtatgcccattatcttaataatttccaccaactgatctataccgctttcaccagagaacaagggcttgcccaaaagcaactcagcaatgacacaagcgcttgaccacacgtcgacctggtttgagtaattagtggcaccaaacatgagttcgggagccctatagtaccttgaacagatgtaagacacattaggctgatccggtttcaagcatttggcactgccaaaatcgcaaatcttgaaagaaaaagttgtcggatccaccagtaggttttgcggttttatatctctgtgacagattcgaggaacgttatgcaaatagtttaaagctttgaatagttggtatgcatagaatttaatttcaacacgcggcatctgcattttcaaattaacaaaatgacgaagcctttggtataacgactgaggcatgtagtccaaaaccagattgaggtatacttcatcttcttcgtccttttcgtaaaagtagtactgtagacccacagtatttggatggcacaacatcttcatagtttcgagctccctatttttatatcttctatcttgtagtactttctttatggcaactttttgattggtctcaattattacagtcgtgactacaacaccaaatgaaccatggccaaccacttctgtcgtaggataactgatgtcgatagttcctccatgattttttcggtcgacatcagttttgcggtcatgtttataaacccgtttatgaactaaacctatgttagtatataatgtgattcccataaaaaatggtagttgatgtaatatggaaaaatgttccgctatgcttcctgatatttcgtaagcaagtttctaagattagggatgcaatttcataaatctttattttacactctctttttttttcttttaattatttttttttgtgtcgcgatactatgaactgacagtagttccactattcactccggttgtgacgaaagaaacattcctccactggcaagaacataaaaaaaaaaaataaaaaataattatacatactagtcctttccttggttttaatatacctataatcaaaattaatcattttctcaaccttctctttactaagcttgctactaatattttcgtgcttattggcaacttttccatctgttttactgtccgagatattggcgtgttcaatgtgatcaactgcaataccctcctttcccccgtctatcagtttagatattataagattctctatgtcgttgatgtactctgaactgttattgaaattaggtacagtatggtgaacttgaacgtcgcttacctttttgattgtatcaggctttctcttcttcttttctagggcagtattactctgtatagatgtcttgtgttttagctgaaggttatctgagttattgaaggaaatctttcgcactaggcttctcaacacatcggtcatagtagactattttacaattttcacctcttcaatcttgagattattttcaagtcccttccccgcagtatggtagaaacggaaatacttgtatgcagcagggttcttatagcaccagtattttttagagaatgcttatttaagttgcaagatatagcgacaaaaggagaaccaatctttctcagatccgccgctggaacagctctccggtagatcctaacggataatgctgcccctggttagttcctcatcggacgactttgctcccaggggcggcctttgtctttctcttttgcagaatcaactctattttccccacccccccgctttttttttttcatgttcctttaccaatctttgaaaaatcacgagatggtgcatatttgacaaggaacgcttaaaacatcgtggagtgagtgtggtaaaggtaaactggtcatagcggaattggtcatagcggcgtagtgcagcgcagccactaggaggatatggtttcctttccttcaatttacttgagtataaaatatcatagtaagcgaaacattatacaacgatatgagtcaagatacaaaggagtatagagttaagaaaaatataaaaattgaagtagctcatagcttggaagagtctaggatgaaactcttgcctttttcaatattcttgcgtagctctttgaccgcagtattaacgagttgttcctctctcggagacagtttttccagaacactggtatcgatggatactacgctaccatttctcaaaacaattggcaaggaaaaatactcaatagagttgtcgccaactaattgctgcgctttcttaccgttttttaagcctggtaaataaacgaatgcggaaagtgactccgtttctggtttctcattatggaagctcctcaaaacttcttcagcaaacttggcccccgcgaacgccatggacaacgtggcggaaccggcgccctgtttagctttgacaatttcatcacctccgaactggaccctatgaatgaagtgctcgtactgcttatcaagttgaaataccagcgatttgtcggtgattattgggataatggtttcccctgaatgacccccaataacagtgacctttctgtgcattgtagttttgtcttgttcttgtccaattttggggttttttagcatcaaataatctaccaaaaaggtttctgcacgtaccaggtcaaggttcgtcacacccataacgtttccaggtttgaacttacccattttcttcaaagtttccacagcaatagggaccaaactgtttacagggtttgaaatgactaaaatcctcgcatttggtgcgaactttccaacagcggttaccaggcttttgacaataccggcgttcatcttgaacaaatcatctctagttaaaccgggctttctgggaacaccagccggtattagcaccacctgagcatttgacaaggtgttctcaatactatccttatcataaccgacacaacttgagttggtgttgatgtgagataaatccttaccaatgccttccgcagctcggatatcgtacaacgccagctcggaaacgtaagggcttaattttagcagtaatgatagcggttgtcccacgccaccagaagcgccaagaattgcgactttgaccatgtttatgattgtttgtctctttttattttcttttgcactgacaagtgttttcccttgatttacgaaggccttgattgttttatgcttgaattcaaacccagcaattcttcctttttcccttagtcttttataggccggcgaaatttatgatgggcagtaaaactccaatagtaacgaaccgaaggggttcaaaagttgtcaactcgtggaaattcacacgtaagaaggatacagaaaatcttgagtaatagaccatgccaagcatgtccactagtcataacggcattgctcgtcatacgatagggtattgaacacctttcggccggaccggcgttaactccggccatataaatgtggtaaaaaagggtactgcgctaatggcctacaagtgttcaaaacctcttctatataataagttatagtgttcttgtacatatgtcgcaggcgcgaatacgtgatgtgattttagctgtttaattttaaattttgttcttttcctaaacaattcacggaaaatcaactgagagatttttaatatatataagaaatactaacaacaataacagcagctgttaagggatcttacttattatttagctcatttataacttctcccaaagtcttctgtttaattctcgaggacttttcatttttagcgttaaaccgctcctgtagtactttcccacagttataatgggtgatgatatttctgccttccctggtgaaccaggaaatcgaatctgttccaaaatttgaaattactttcttgcaaataggacatttatggctatctgataagactccatacgatgacatgcgttcattgagtttgtatgtggtggccacaagctcaacctggaggagtgccttttctaatctggtctcatccatctttgatgtgtgcttctttaataattgcgacaccaccctaccaatatcgtacaaggaaatatcttgaggtaaatttttgtatatttccgctgaattcaattttgaaccatggtcttgcaaaaaattcagaatcagcttggagttcctattggaatcgtatatggagactaacttgctgtacaagtacaatagaagctcttctccctttgtcgaatcactttggtacacgtcgttacagtaacttgtcgccgctttgtaatcatctatctcatcaagtaatatatgcacagcttccttatggttttctaattttgataaggggaaaatctttaggtactttacgaaatttagttgattggttggcaactggtcagagccactctcaatagcatcgttcaataactttaaaattgttctaggctcatagacagatgttgtttctaataaagactttaatttgattcttgtggagggaatatctaagttttcaagatataacttgatcaggacagtatgcaatttatttccctctaatctaaaagtactaattgcaaattctaagtattgtatggcaagtaacttgtcgaactttttgatgtacccatacactttcaaatggtccctactgctacaggcttgagaatcataaaaaaaaatcgaggaaaggatttctttaattgagtcgttgtgtcgatttagtagccaatcagtataagtgaatataacgtctaactgcgggtttgataattttttcaaataataaataactaatattttgacaccgtgatcgattttttggcgttgtttctggtcagtattatcattttccaactcatcgaccaaatccgtgagaaatttcaaagcttcttcatgattaccacgtttatagtaaaaatcaattaaatctttgaacatatggcgtatttttaattcggtcactataacatgggaatcgcagtggttttctacacgaatgaatggacccaccatgggggggttatagtaaagataacatttgaataaaactgtatctatcagagttaacattgtgttaaggtcaacatcatcgtggttgctgatcagaaagaaatcaaaactttgcttgatttcacggtcgcgatagcaccaagttatgcggctttcgtcatcgttttccttgcttaataagttttgcaaatgtcgccttgtgtcagtcaaataaggtaaacaccatctgttcaataagtgtggcgggatgtcataagtttccttaacctcctcggcttccttcaacaagcagtgatgctcttggcccgtaatttccaataccaagcttgaaatggctgagggaaaaactttcaaaataactaattgaggtggagcccaaaattttataaataggtcaaaaatactcttgatgatcatttcttcacatttagaacgaatcattctcgagtttctactcctttctagttgtaccatataattttgaaacttatcgaagattcttagacaccacatcactgttaaatcccttagtttcatagcacatatatccaaggattcttctggattgtccgaaacacataactccttagaatgaggagaatcaatgaagaacttatagaaaagcacttttctccatagttgataaaaatcaggatcattaatgtcaccacaaatagactcttgatcatcatcttcagagccatcatctacatgataagagaataactgtacttcgtcgtttgaagtccatactaaaaagtaggttcccgagagatttttgacccattttataccttctggtattttttgttgcaaaaaagtaaatccattttcataatcaacaaacttgatggtacttgaattatataacatcaggaggttggacgacaaatattgcatgtgatcgaattcggaatttgattcggaaaatgtagcatggtcagtggcgatcaaaaatggttcctcattgttatgcattaactctaccttgaaaattttttttgtagcaccatcaattatcattggggtagcgtcattgccgtccaattcaaaagtatatcgtattttgttgccacgctcgtttcttatggtcctataccataagcttgacatgctcgacttcctggacattctatccatagaagaaaaggattgagcatcaaaatggctattctttttgggcttcttttcaatgactttctccgcctgctctttgagttcggttaatgctgatatcatatcttttgggaatttgtttttcactgttttttctattctgattagagagggtttattatatggccaatgatagatacctaaatctgtcgctaaggtgattcctgtttcaccaggatatatggaccgaatggtttcctttctatacgataacgatgcttccatcatatttttgtaagtcctaccctcccatattaatactctcatcttggcagtattgatggttgaatatattaggtaagtattcttttcttctttatttttgtgtgacctttcaaagagccagcaatggtttatacctcttctgtcaattattcgatcatattcgtgtaaatttgtagtgctcaataaaattaaggtttctttacattgtgcaaagatagttgaaagctcgttggcaaaataaaagttttcaatcactggaggcaaaggatcatttttggcgttttgtaagagatcaggatatacttgaaataatttgagtgtattgccatctcgagagtaaacttcaacgtcaccatttttctttgctaaaactaatttttgtgactgttcagtgggcaaaatcgcagtgatatccgatgatttcagcgagtgtagcttttgagctcttaacatttaatttttggtataaattgatattttgaagggtttttgctgatcaatataagacccgtccggttgaaaagataattgaacagccgtaaacctaattacaggaatcgctctcaattggtaagatttacacgattagagcttgacttttggcagagtttgtcacagtccacgttttgtttggcgccctggggtccttttcataaaatatcgtttactaccgattcggaattaatataatctgagggccccgaaaatggcttagttacacatattataaccagtctaattaaaaaagcaagcacctaggacggcatgttaatgtatggaagaagagtatgaatttgcaggagagtgagacaaccaaactatccagttatagaaacttataaagtgaagcttttgttatatagtacaacgcatcgtatattcctcaaagcaataatacagaagtagcgcagcagaatgatattttgaattaaattaaatacacacatggcgccaactaaggttggaagggaaagaaggacgaccaatattatgtctttccttaggtccattttaaatttttaatatacccgtttggttcatgaggtttatctctatctagtctttgcttaatgacaatactatagataccgtaactcagtccatcgtgtataacggtggcttccgatccccattcccgcgatgttatatcaaatctttttacgctaggatacttttgtagagtaggcaaaaacaacaactccacctctagatcaaaaggtgtgccttccagtaggggaaggttacctgtaacattatcttgattagttacatttacaggggttcttctcaatttgtgaaatgagccaccagaaggcgctccaattttgaacccgcaatgtcttaaaactagtattgggtctgagtcatcagaatagatatcacatccccatatctcattatttctctttctaggagattctatattattgaaacttgcctgaatatcttcatatgttatttttagcgttgcaatattattgatattttgaataccgatagctggaaggaacggtggtggaagagtgttgtcataaaggttgtatggaaaactgtgcctgtctgagtaacttgtggagtcttcatcaaaagacccttctttgaaacgattgtaataaagtgtacccaagttttttaacttgtttggatagtgtttctcagtgaaagcaagaaccgactgtgaacttacattaggcaggtcgtaggccgaatttctgccgttttggtaatgcatatactgctctggaaaagaatgggtgttgctttcttgtccctcctcttgcttattttttgttctcgccgaatttagtagtgtttcctgtagtttatatatctgggattgagtctctctgtacgccctattaggatcttgttcgcttaccgacatttttatcttatattgtattgttacttctctcaaaaaaaaaactgcgagtaaattttcccttaccttcgtactaaaataccgttatttgtcaaaacgctgtcatggaattctatagcacttgatgccggaatggagatgcttattcttgtgttctacattcatgaagtgctgatactatattttgttttcccgaacctctccccttctgggccctttttccattattcacaatattttcatacctttacctccgtacaccaatctttatttttacccccatacctttgtattctgaaattgagaaatgatttgtggtgcttttttttttggacaatctgccttcgtggacagttttgaaacgctaggcgacagttttgcaacggaaggaagtgggagagcccagaaaggctttctctcgatggtggatcattcttgcgcaggcggaggatgggaaagctccgttcaggtttgcggcttttctttctggcattttcgttctcccaactgcgcaggcagacatagcttgactttactcatgctcgcattaggcgggttgaatctcatagcttgaaagatagtattgaattatattgaagattttataactagtgataatttcattcaagttttaaagaaagaattaataagcaaacagaactcaatcaaaggaaaaatggccggtttgaaagacgttgtcactcgtgaatacaccattaacttgcacaaaagagtatgtgaaagaataaaaatataatgcccaagggcttgtcatctgaatggttaattaagaagatatttctatagtcaaggaatacaatatcaagaatttgtaccacagaaacctatcaacaaagatcattgatcaagatatattttataatacggaatttgaagaccataatcaatattataacatccaagaggggaaagatacacttcggctggacttaaagagcgatgaagacagaaatagttatcttaaatagtggaatcctagattttaagtcgacaattatccatatcccaagtttgactaaatatgaatcagaacaaattgggtctccaatatacaaaaccattcatcaagattacactaatattaaaatgaacaatcgttactaacaaaaaatttaccattttatttttaatagttgcacggtgtctccttcaagaagagagctccaagagctgtcaaggaaattaagaagttcgccaagttacacatgggtactgatgatgtccgtctagctccagaattgaaccaagctatctggaagagaggtgtcaagggtgttgaatacagattaagattgagaatttccagaaagagaaacgaagaagaagacgccaagaacccattgttctcctacgttgaacctgtcttagttgcttctgccaagggtctacaaactgttgttgtcgaagaagatgcttaaatcaattaaataaaaataatactcattttatattaataaatataaagtaaacattttcgatttgtataaatctcttgtactcaagccaagacttctgtattcattgaagcggggcactcagatcaatttttatcaatgatatcatctgctacgcttgtacaaagggttaccttcgaattatttaaaagatgcaagtctacgtataagtgaaggcgataaaaatggataaatcagtgtaactatgactataaggttatgttggccactcatcacattaaaagactcccaatattctccaacagaaacgaagtataccgtgcgtctgattatggtccaccagaacgatgagatcataaagacacaaagtaaatgagaagttttacaatattgaaaaaatactgtaaaaggatggtcttaaaaagtagttttgaagtacttctgttcttaatagaccaacggaaaattaaaatcttcatcattaaaagtccataattcattcgctttcagcaaaacatagagcagcaagaagctaaagaaatgacaagaactatcggcagagtgaactcactataccattaatcttatcacccgtttataaatctattcttgtcctttccagttgatatgattctgctattatccttgttccccccaaggactgcagtagaagagttatgttacaaatgttgatatatatatatatatatatatatatatatgtatggacatttgtgatgaaaatatatcttgaacaagcgcgattaaggtcataataaaaaatcacagaaaatttttcaggtcgcgggcgttctctcacccggccgcccaaagtattatatgaatctttagggcttgtaggaattatcagcatgatatgtacaattagagtttttctttggaaacatgcgacagtagacgtcactctttgattcagaagttaggctaggatgtacgcaaataaaataaaagcaatgacaaaactagatttacatatattatatgtatatgtatgtggaggatataacacaaacagtggaaaagtggtagaataattagtattacaagtgcactgtcaataaatcattggaactgaatgctttgttgcatgtagggcattttctcattctcgctgccaatcgttccttacagcaattctcacaaaagacatggccacaggttttaatagccatgtttttccaatttttagaacacagggaacaataaacaagtgtacggaaatttgctagttcttctacgagtgcttcatcgctcgagcccttatttttgttgttaccacggaacaatgtatcatgtagtttttcacacttggattctagatgagatgccttctgcttgaagtgcttcaattctatttctgtatcatttaatttagtttctagatgcgtcatatctgcaatgcttttgttactttcttcttgtagcttttctaatgaccttttcagtttagtggatgtattatttaaatcaattatttttagtgtctctgttttactggaatcaattaacctgcgttcattattttgagaaagatccagttgtttatgtaaatttcctattttttgctgtagcaatctatcagagtcctttaactgtagaataagctcatttgatttactgaggcttttagaaagagttttgatttcaattaaaattgaatctttggacctcatcgcggcaaaatatttctgatcagccttagttttttctacggtaagcttggatataacagattcgtgattaataatctcagagtactttttatgagttaagtcggataactctctaaaacccttctctaagtcttgaatttcctttattaatgcatcttgagtcgacgaggattttgtatcgtttgatctttgatcaatttttgtccattgctccttcaaaatatcaattgcatgttgtaaatcgctcaacacttcagtcttggatttttcagcttccaaaatggcgattttgcttagtaaatcatcacgagccgttcttattcttacaacgtccttttccaatgaactgttcatttctactagggagtcgagacttttctggaattcttctcggaccttcttcgtatatatttctttctctttggctaaaacttgaaattttgataaaaaggaactattgatctcagataattctgcgttttgttcagtcaaatgttgaatttttgctaacagggactcatggtcatatgacttgaaatctgggtcttggtctgctgctgctatctgttgcttttttaaattggatacctcagaacgtgttttgatgagctcttcctcgttttcccttctgatattttcaaggtcttttatagtggaactcaaggagtttatctctgcccgtaaatcagaaaatttcagatccaattctaatttttcattctcagcatcttcttttcgttcatcctccgcctgcacaagttcatcacctttctcggattttttggatgtattatcaccattaattgcagaggagtctttatttccagattttatattgttttcattagattctttttcatcttcccgtaattcctttacagcatcagtcttatcttccttaaaaacacgttttatagtaaaggattcatctctatcatacttgcgaattatatttgtataatattccttcaaagcagaaatctcctctgtcaattgcgaattttcataaaagagctcctctttacttttccgcaagttttttaactccgttgttaattcttgaatatgatccgaagcattactattagtattactatctgtcgtgtttggcttcccatatttagtcagtagcttcatgaaagaatcactgcgctgaactatcaacgtctcatcgccttgggctatttccctacatagttgcttctcgttggcgtctgtgcagaatgtttcgataaacctagctaaagttactatcagcgccataatatttgccaacttgcgggaaacatctatgcactcccttcttgaaagttcatattgctttcgcaaggcttcaaagtcgactcttcgacgatttatacatctaaacaaagcttctttttgaaacgctatcacatcagattgagtaagcggttcactaggatcgcttaattctagcttgatcttcttagtagcaggctcggccgtcatatctgattattatcagctagcacgattagcataaaaacggtgaaagccctttctatctctgttaaaaaccttggggcgctctctgttagtttaccgttcaaacaacatccatccaactttttttaatcttcttcttttttgttttttcgccttctttaagaaagtttcgttggatgtgattataatcacgtgatcaaatgcttttgtcacttttatataataacgatggtttgatcaaagtacgatcagttggtgcttcatttcaaagttagaagacatccttagtgcctattgtcgatctgctctttctttttgaatccactgaaattaacgatctcagaatttcaccagtgattttcccaatattatctttcgtgggtagagaaacaattctgaactcgattgtgcttcgtatgctatatacgcattgttgtagcactaaagatcatattgctcattaagcatgggtcctgccatacataatcaactatatgaatgtggattaaagactacgtctcaagatggcttcttgatggacaattatgaaactcaattatttcaatcgttgaacaggtttatcaatttcataaacaatgctaatcagtcagctagtaataaagaacaaaatacaaaattttgcaaatcctcctcaaattttttacgcttgaaactactaacggttctaagacaatggtgtgattcttcacgaagcaactgtacactggaggttagagatgttttgacccaatggtgggtcacacttttaaactttctaaattctgacacctcgcttcaaatagatactgcccttgaattgagcttgagcatagaactaacttccgtgtgtctcgagtgcctcagcaaaattatgaccatactaataatattgcctttccattcatccagagacatggaaatatactcacatcatcttttgctgaccattcattgcataacaaacaagttgattttgatttctaaaaactccaaaaaacttaaacgtacaaatagtgatgacaagtgctctataaacgacaagaagctgcaataccttaacaaatattcttccttgctgcgagcattcatcgggaagttaaatgcttacgcatttttttatctaccagaagactttcatttcgatacaattttgttattgacagtttctcctcaaatctcttcaagtattcaaacatctttgttttcatggaagaagagacaatataaattcaccgacgatcagggacaaatgatccgcactgaagcttttgaaaataaagatactaaattttttaagatcattgtttcttatattaaaaatgattttgtacttatgtcattttattggcactattggtatatcatacttcaatttatgaaattctctgattcagatgtaggaattaaaaaatcgacattgtcatgcatacctggctcagaaattttattgacgcatgtaaccactagattcttgaattcagatttgaataaattcacgcggattattaaacaaacgccgaatccaaggatagcaaatgagaatgtgacagagtcacatccaaatttcaagagtttgaatagtagcaatgctttaattacatctgaaaggattaatgattacgtattttctaattttaagacaatcaaattatgggaatgtcttagaagcctttcaggatgcattcttaaagaaaatcatccggaatacctggaaaatatgctttccttacatgagtctctattgatagactatgtctccactatttcagcgtacgattatattgcagcgaacgtcatttacaataaggttctccagtttattattttccagtttgaaagtttaccttctctgaaattcattcaatggaggtcgtggtacaatgggcttttgagtatgttaaggaccaaaaatgttaactgccagactgtttctttattatgccttttcaatatttggaagcacgtaaccattgaggaccgcgatgaaatagtaaaagtgctgttaagtgatttttgggagtcattgatttttgaaaacgaatttcctttgattagaattttatttatgaaggtattagtttttaaaatcattccaagtgttcaaaattcttcttcattacgattcttgccacatgatagaattaaacaactatatgaagagctactggtaaacaaggaggagttatttgagatgcaaaaacacgattcaaatgatatagtggcgcatagaaagaatgctctcgtttttaatggtaactcacgtttgatgatgattccaaaaaaaccaaatacagaggaccacttagtttataagattaatcatgataaaaatttaactacagaaagatttccctctgtcagctcagtggcaaatacaagacctaacgttatcttgaaaaatggtaaatacgcttatgatattttggacgaaatgacaagtaaagctgcctttcttcttgcagaaaagaagacccgactaaatcccaaaaaaaatcacaaaattatggatggctacgaaggaggtcaggaaaacgaagataatgatgaagactcagaagatagtggctcgcataaaaataagagaaaggaaggtaatagttctttatcggcaacactgaacacttggctttcaaaattttcaagtacttctgaagattcacagaagaagaaggaacaggcaaatgaattaggcaacgattttgaatatgatgaagatgtggctgattttgcagaaattttgccgaagcagtcatctagtaatattgaaaaaatttttaagcatggtaacaattcaggatcaatggtatcatataattcaagtatcaagctcaataggagggagaatatattgataggtccaccagagttgagattttctaatgaaatcaaggaacacaatagtattgctacaatattcaaactggtatttattcaaaccaatagaagagtcgtcgaaaaaatagatttggcgaacatgaaatgggggacaatccacggaggcagtaagtacatgaagcctttacccgtcccgaaagatttggttgcgagtgttgctaagaacgaaagtgagacgagaaacttagctaccttatgcggtaatggtctagattttgagataccggtgcctgattttaatatttttggcaaatgtatggaagatgagcaagatgtagccaaaattggtaatcagaatgtggaagatttgaaagttactggggggcgggaggtgacaatttggaagcagatccaagatatgaagttgagaacaaggatacaaaaaatctgtgttttaattgagacgttcaatgctacagtaagagaatattttgagttttccaatcgattagagcatgacggtatatttatagattttgaagtgaggaaacctagtagtaataattctattaatatcaaagtctgaataatagaatgagttacatacgtaaacgtgtagtattattattattattctatttcctttccgtttttattatttatatatatatatatatatatatatatttgggtgtttatatttaggtagggcataaggatttactgtcggcatgaacctacttgaacaaaaaaataaaaatcaaaagaaaaataatgtaggcttttgcacatcgactatatataaatatatatatacacacttctgtgcagaagaaaaggaataaaacgtcaaactaatttatttcttcttgcaacgattccgacttctcctttaaacgtgcaatttcgtcatcgatgtcctgaattttcttcaatagttcaaaatttttctcatcgccgtggtcatccttggaagcgccggattgagcagcagcttcggcagtaacagagtcgttcttcttgacatcgctggaggctactggaggcgatgctctgtatatgtctttcatggttaaaagttctatgactagcccaaaagtcctaacgacgacaaaggtcaaaaacaaagttatacctgtcaaatacatattcctttgggcaaagaatttcctagaaagaacctcaattctatcttgagcgattatagcgccattattttgagaggcgctacttaactgcagctctttgtcgatgctgtacactctgttgatacaatcgatgaaaagcaaaagaatgaacccaagtacacacttgatcgcaacttgcactgtggaggatttgaacggctttaataacagtaaggtgagaggcctacggtatctagaagggattggtagggctagaatggagaacatgaaaatctccaccactagaatggcaaaaaccaaggtgtaatataatgacatgattcaattctgtgaattctatggttatgagtataatgtgacgtggttaccttggaagagctcactattctatcttcctactaaatcgggatttgctatataccattgttatatacggcactttttccactcttcttccccttaatggagtgaagcaggcagggtgaccctctagctaaaaaaagaaagaggcgaaaaaagagtgcaacgtcaacaacgctaaaagagaaagggagaaacgcgcaagtgtttacgcatagagggtgaacaggagcaagagcattttgatagcacacagacttttaataataaagcggcagagaatgactcaaataaatgcgcgatgatattgggaagaggctcaagcaattcgtgaggcgcaaccaacgccagtttttcgttgctcgtgcacagtgacacggtggcaaaatggtcgacgttggcgcttgtttcggccactttgttattcggaagagattttatatataaggcgggcgcggtagccagaaaagagcgaaaaagagagaacgcggaaaaactgaaacaaacagattgagcgaaataaacctcggcggctatgtctcgtactaacatggatacaagacacgcacattctgctttactggcagcaccacagagtgctactgcaaatagcaggagcagcaacagcagcagcgagagtagtagtaacaaaaacaatatcaatgtcggcgtcggtgacgatagcggtaatgtcagcgcggtaagtatcgacgatggaccccacttcagggatatcttccactatggacacgaggaaaattacaaacttgcgagcagcggtatcactaacctgaattcttcatcccacgcccaccaaactttgtctcccatttccattagtaatgcatccactccggaaagttttcccgagcaccctttgggcctagaacgggaaacagagccggcgttggaagctgaaatggaagcggaggaactaccaccacaccaaagtaaataccttttaagctccattaaggcgaccaaacgattaaaagatgctagaccgtttctgaagccggttgatcctattgctttgaacatcccgcattatttcaactacgttcaaaccccaatggatttgtctttaattgaaacaaaattgcagggcaacgtgtatcattcagtagagcaagtcacatcggacttcaaaacaatggtggataattgtttaaactttaatggtccagaatcttcaatctcttcgatggctaaaaggattcaaaagtattttgaaaaaaagttatctgcaatgccaccaagagttttacccgcttctgccttgaagaaaacaagcagaaaccggaaaaaaaatgaggatatggattccccacttgtcattagacgttcagttagtaccaccaatgacaatattggggaaagcggaaatagagaaggcgtcagtggtggtagacccaaaagaacaattcatccacccaaatcaaaagatttgtttgatatatatgaaaactccaaaccaaaatcaaagactttacaaaaaaaattcaggacttgtctgaaaatactaaaggttttgatgagtaaaaaaaattcggatataaattttccctttttacaacctgttgatccgattgctttgaatctaccaaattactttgatgtcgtgaagaatcctatggatttgggtacaatatcaaataatttaatgaactggaagtacaaaacaattgatcaatttgtcgacgacctcaaccttgtcttttataattgtttccaattcaatccagaaggcaatgaagtccattcaatgggcaaaaaactaaaagagcttttcaattttcattggttagagaaccaggatattttgaatgaaattgaaacggattcagatcttgaagaggataactattcttcttcatattcatctgatgatgaatatgatgatgaagacataaatgaaaacgatataactaatccggctattcaatatttggaacaaaaactgaagaaaatggaggttgaattgcaacaattgaaaagacaagagttaagtaaattatcgaaggaaaggaagaggaagcatctaggtaaaacgcttttgcgtaggaaggcaatgaagcattcagttgacgatttaaagaaatctattactgataaaatcaatgaattaagtgatttagaaatgaatgggatgattcgtatcattaaaaattcattacccgcagatgaaatactaacttccaatgaagatgaaattgaaattgatttggatattttagatgaagcgactattgcaagaatttatgagagatattttgagaaaaaaaataacaacaatagcaaaagaaaactaagtggcaactactcgactgcgccaactaacaagaaaaagaaaaccttgaaatttttggaaaaggatgaaatcataaataataataattattccgattctgaagaagacagtagtgatagtagcgacagtgacagtgattaacaatcgaaatgggcttcatgccctaattaaggaaaaaaagaaaagaaaaaaaaattgggaagaatggggataaaaaagatttgtaacattataaacaaaaataagaaataattgtttttacgtacttattgtaaataaaacaaagggataacggacaaaaaggcatcgtttcttttgtactatgatttacgcaaatggtaattaattagaggtatgcatatagtttttataattgattcaatgaattttttgttatcgtttttaatttcgagtaatttcaggtaaccaataaaggataagatcactttccaatcgttcaagttctgaaaatcattagagctggaagttaatcccatttccttcggcaaattggcaggtattcgcaaatgagctaattggttaattttcaacgaattcttgataagccagcttatcgagtccatgttcactactcgagctcgatctaagttatgaatgtaattgaagtttttgttcattatattaaactgattgaaattcgtaaatgttattgtaagcatcttattaatttccaagtgaatgagctgttcacccaatttttgtaaagtttcgtttcttgtttcaaatgtatttcctgtgctcaagtctccagtcattggtactcgtaccaacatattcctgcttgtggtatatagcagtttagttagttctttagtcggtatgcgttcctttcctttatatccgtcaggattaacttcaaggacttcacacagtttttctatcttactaatattctttttcgtcaccgtgtttatagttctgatgggaatatacctgcgaatcccagatattcgagcaacagtagttgcaaacacttttgtcctcaacatgtcgagattcattatctgatttattcttttatcctgctataaagaaaccatagaagaatagaagcaaaggggtagtacgtggcacctcctaaaggtaatattgtactattcctagttcactcaaggtctgcctgtcttattctccacatacattttctataactctttttttaagtttgtttttattttagtttgacactacataaatatgtaaaactattttttcaaattatacaaatagaaaattatgataaaggtcaaaaagaaagaaaagaatgacttgtctgttttccttccctacaaactcttgcaaaagtaatcaatcgaggccagcacagaaaaaaaataaaagataaataaataggaataagaatataatgcgaaaaacaatagtggtcaggttcggtcagttctcttgctttttcctctcagctagctctgcgtagaacttctctctcttgttaatcttatccatgtggaatccccaccaccagtaagaggccatgacacccccgagggagaacccgaggacgatgtccatgatgactcttctcttgatcgtaccagtaattggagcaatagtcatgtctgtgtaagtcgcttgtagttagtagtttgcaaatatcttgcttgctctaattctcggtcctaattttccctgaagataagagtctctttcatcgattcttttaataccacaggaacaaagcgggcatcgtggtagcgggccaatcaggttgcagtaaatgaagagatatagaggaggactctgctaaagaccataacaagggtctgcaatgatcttggactaaataaaggtgtcttacaatccaaaagagcttgaatcattccttttatgagctaaatagcaccgtttgcaccttctgataacgctttacgggtcacgcgcggattttgactcacataattccacttgcccatataaagagggactcatatgatcttatgaaatcttccttcaagcaattgtgagacaacagacgcacaaggaagatcgcccagcatgagtatgttatctagaagattattttccacctctcgccttgctgctttcagtaagattaaggtcaaacaacccgttgtcgagttggacggtgatgaaatgacccgtatcatttgggataagatcaagaagaaattgattctaccctacttggacgtagatttgaagtactacgacttatctgtcgaatctcgtgacgccacctccgacaagattactcaggatgctgctgaggcgatcaagaagtatggtgttggtatcaaatgtgccaccatcactcctgatgaagctcgtgtgaaggaattcaacctgcacaagatgtggaaatctcctaatggtaccatcagaaacattctcggcggtacagtgttcagagagcccattgtgattcctagaattcctagactggtcccacgttgggaaaaaccaatcattattggaagacacgcccacggtgatcaatataaagctacggacacactgatcccaggcccaggatctttggaactggtctacaagccatccgaccctacgactgctcaaccacaaactttgaaagtgtatgactacaagggcagtggtgtggccatggccatgtacaatactgacgaatccatcgaagggtttgctcattcgtctttcaagctggccattgacaaaaagctaaatcttttcttgtcaaccaagaacactattttgaagaaatatgacggtcggttcaaagacattttccaagaagtttatgaagctcaatataaatccaaattcgaacaactagggatccactatgaacaccgtttaattgatgatatggtcgctcaaatgataaaatctaaaggtggctttatcatggcgctaaagaactatgacggtgatgtccaatctgacatcgtcgctcaaggatttggctccttaggtttgatgacttctatcttagttacaccagacggtaaaactttcgaaagtgaagctgctcatggtaccgtgacaagacattatagaaagtaccaaaagggtgaagaaacttctacaaactccattgcatccattttcgcgtggtcgagaggtctattgaagagaggtgaattggacaatactcctgctttgtgtaaatttgccaatattttggaatccgccactttgaacacagttcagcaagacggtatcatgacgaaggacttggctttggcttgcggtaacaacgaaagatctgcttatgttaccacagaagaatttttggatgccgttgaaaaaagactacaaaaagaaatcaagtcgatcgagtaatcgaatttacgtagcccaatctaccacttttttttttcattttttaaagtgttatacttagttatgctctaggataatgaactacttttttttttttttttttactgttatcataaatatatataccttattgttgtttgcaaccgtcggttaattccttatcaaggttccccaagttcggatcattaccatcaatttccaacattttcatgagttcttcttcttcattaccgtgttttagggggctgttcgcacttctaatagggctatcaccaagctgttctaattcgtccaaaagttcagtaacacgatctttatgctttagctcgtcataatctttcaattcataaatatttacaatttcgtctacgatattaaattgcctcttgtaggtgcctatcttttccttatgctcttcattttcaccgttttcttgaaaccaaacaccgaactcactacgcatttctttcataggctcatataatacttcttttgacgtcatttgatcaagtatttttgttattgcgtcgtccatctccccatcttttagatcaaattgattttctgcactttcttttccaccagatgctaccatttgatctaataattgtgacaatatatcatcaatattattattttggccactgcgttgagattccttggtttcttcggctagggatgtatcaactttattaccattttcctttaacctgtctagcgtattggaaacaatgtttttaaatcccggattgctaccattcacggtccctttatcagtgctgttacttttcaaactactacatccttgctccatctgttgatgaggtactttagctgcctcttctagagcactaatcagtttattaaaatcttctgtcttcacattattctcgttaccgttatttttcatcaaatttgcgaactcattttgcaaatctaccatcatttctttcaattctgggtcctcttcagattcattagctacctgtacgccatcactgtccttactttcggcattcttctctttgttttcactatcgttgtacacagaacccttcgcttgcacatcatcgggctctgcttcatccagtttagtgggatcttcatctaaaaggtcatccaaatcatcaaaattatcgtactcgttttcattcattacttcgtgttgtatgtttggcatttcttctttccgtcaatacttcggttcccacaatttgtaattctttcttcactttatatctctcagaaaccgcgtttaacatctggaaattaaaaattattcctgtctccataacaaacatttaaaaaaagaagagaaatttagcataggataagcacacactggcaccattttttggaagcaatatgagtagtttgtgtctacagcgtcttcaggaagaaaggtaagtagtagttttcctccttttatgcttacattctgtaggcatacacaatttcatccagcggtatactaacaaatcgatgaacttaacttgttttacttgaataacagaaaaaaatggagaaaggatcatccatttggattttatgccaaaccagttaagaaagctgatgggtccatggatttacagaaatgggaagctggtatcccaggcaaagaaggtacaaactgggcgggtggtgtgtacccaattacagtcgaatatccaaatgaatatccttcaaaacctccaaaggttaaatttccagccggattttatcatccaaacgtgtatccaagtggcacaatatgtttaagtattttaaatgaagatcaagattggagacccgccatcacgttaaaacaaattgttcttggggttcaggatcttttagactctccaaatccaaattcccctgctcaagagcctgcatggagatcattttcaagaaataaggcggaatatgacaagaaagttttgcttcaagctaaacagtactctaaatagagggaatccatctttcccattcttcctccttttgtactttatttaactaatgtcgttgtgtaacaaaaatagagcaaaataacattatttacaaattctcaaaaataattttttgctctttgtttcttatgctaagtaaatagaaagatattttttgtaccattttctataagtatggcaactatatacactttaataaatctattggttagtagaattttcattcattttgtagtgaatgaaactatccaacgtagtaaagcaatcatggcatctttcttttagttcgggatttttgtttttatcaaccattttgaattgctgcctcaaatttggtacaacttggtcttttagaatagataaaaatccaccccttacaaatattggttcattatagtcgtaagaggcatccccgtaaatttggaaaagcgaatttgtcatttctatcaaaatttcagggcgaacattcaactgtgttaaagtttgtatgaagaactgcccaatctccttatttgcatcaatttgtccctgaatcatagcatatgtgcttagtacattaatacatttttgttgtaactcaaggtcattattattttggaactcttcaataattcccctagcgaatcctgaattgttcagcatttggacattgatcaatgctcgattctcactttcaaacgctccatcaggaaagatgagtttcagaagcgcccaaatacagcccattcttcctattttaatactcaaatcatcttggctgtccaactgtgtaacataactccataaggtggttaacaactctccagagagctctgttagagatagagacacaaagagccagatcagattgttccatccgatcaatattcgcgaggtgaaggtatctttcaaaatcatgaaaacgtgaggtaagaaatttgttaaggtattgattagctcctctggaattgctacttcctgtgattctggtgattcatatttggatgcaactatctcaatgattgcggtgataagatcaattgctatttcaatgctttgcaattttatcatggattcgttacgtttcgcattgtaatccttgatcttagttataaccttactgctttcatctttactagtagcaggtccaatttctacagggttattaatgtcattaactaactgtactggatcaatgttattaatggaatgacatacagagtggatcattttgttacattgatcataagttattttcatgtcaaggaattggcaatggataccttcaattagaacttttgttaattcattagcttgtggatgtaaagccggagatagcccatttaagaactgtgatagaagttcattgttggaaacatgatcaataaattcaaatgattcggaactcaaatcataaatgagatcaagagtggtattgaacagattaattggcagtttctcgacaccatattttaatagctgtgaaatgacctgaaaaatttcatttattttactttccgttaatatctcattaagaatatcgtcggatccattagacagagccaccactaacgacagtaagttatcggcaaaatcgaataacaaccttttagattctattttggattttcctgcaggttttagctgcggttgctgttctgctgcttgcaaagcggataacgattcaacaatcctgccaaaattacttgttatacttgtccatatatcagatctccaaaggtagattgacacatcataaccttcttccaaagacaagttccttaataagccgaacgactccacaactatgtccgaattagaatcgttcagcaatttattcaaaatgataggaactaatttctctttcagtaaaagttgtctcatatgtgcatcctcacaaagaacactgatggaactcaaagcaatacttctatcattaggcaccacacttgacaaattctgcaatagcggctggagttttttattaacgacgttggtatctttattattgtcatttgacccagctttgcgtagtggatttaatcgagacgaagatgctcttgatcttttctttgatctgcccattcttttctgccctaaaaagtcgatttctgcgtccttgtacaaactcgaaaatctgatcgaaagtacttggaatccagtaagaataatgggggcgttgctacgaagatttaattttacaatacatagacctttaaacaatggtagataaatggatgagatgagatgagatgagatgagatgagatgaaaaattttctgaataagagaactactcgttctaaatgattattgtacattttgcatagaaaaatggcaataaacagggcagtactatttcatcatcatcactaaacattagttggcaaacttattaagccaacagtacttgtgactagaattttttattatatcgccaatatttaatgataaacataatatagtaataccaaaaataattatgataacttatacaaaagaagtggaaagaaaaggaaagaagtaatcaaagtaactcaaaaaaggttaatgattacgatgttacaatcgctcttgacttatctgtacttgtggaaaccaatgtcgttagccttttctctgaaacattgacgacagatgtttaagtcgtactttctgaccaaaccagtgtgggaggagcagacacgacattgacgggaacctttaccgaatcttcttgggtgggagaaccaaacgttttcgtgagccattttgtatatattctataaccaataagttttcaaaattgaatagaaaaatgttagtattataatttttgcagtttttatgttttccaggagttccatggacgtgtacaatagaatttttcgactatcgaagttaaaaggaaataaatataagcttatgctatggctcattgtatttgacataatttgaagctttgttgatgtttgatgcttgttgctacattcaataaacacatcgtcttattccaccatggggccaccagaaaggctcccccctactgctagccacagatattttcctcgaattttcaattcttttagttgtaaattttagttacaaatccaaatcagcgcagatactttcctgctgttccttcattctgcatacacgtcccttgtctcttcaatccgcgtttccacatacatttagctatagtttctttcaaagaatttctcaaactactaatcccaatacctaataaccacttcttgtactgacggttatacctttaagacttgacgctttcccaggcaaaatgtaacattttccaccgcgctgttcgtacaacgcgagaagatctttataaagagtacccagatgttccccccaagtgaaataaataggcctacttaggactgggtgttaaaatgtacggatggaaaagtagactcgatattcaattacagctaagaaaaattttcagttctgctcatctcatcaccagtaaaaaaatgtgtgagttagaagttgatatgagttgtgatattaatcgcagaaatttatttgttagttgaagagcggtagttttacgcaggcatcagaatggcaggtcattcacacaggtcatcattaaaaaacggacacaaatcttacaaatccaaacatgcttctaaaggtgctttgaaaagattatacaaggggaaagtggaaaaagaacccgtgggcactggcaaaccagacaaacaagtttcaaaattgcaacgtaaaaacaaggcaaaacaattaagggcccaaaggatcttggattccattgaaaacaggaaattattcgaaggaaaaaatggcgctgccaaaatcattactattgttccgttagtgaatgatttagacccattggacattctttacaagctattaaagtgtgcagatgatgaaggaatcatggtgcaggaagtagactcaaaacgtatatttaatgttcatataaagaagtttaaaagcaatcttaaaatcataattccagacatgaccaattttttgaacattttagattgcgctaaagtagcagactttgttgtgtttgggctcagtggtgtccaagaagtcgatgaagaatttggtgagcagatcatccgtgcgttagaactacaaggtattgcttcatatatcggtgtcataagcaacctctcagcagtccatgaaaaggagaaattccaattggatgtcaagcaatccttagaaagttatttcaagcactttttcccaagtgaagaacgtgtttataatttggaaaaaaactcagacgctttaaacgtcttgagaacattgtgccagaggctaccaagatcaatcaattggagagacaatagaggttacgtagtcgctgactttgttgatttcgttgaaacctctcccgattctggtgacctggtaattgaggggaccgtccgtggtattggcttcaacgccaatagactggtccatattcctgattttggtgacttccaactgaataagatagaaaaaatcagtgaatcttcgcagaaaaggaaaataataaaggaaaaagctacagatagtctgagcttagagctggatttacaaacagttttcgaaagtaatatgaatagagatactttggacgaatatgccccagaaggcacggaagattggtcagattatgacgaggattttgagtacgacggtttgacaaccgcgagatacgacgaccatggcttcttgccagggagggaacaaacatcaaaaaaggcggcagttcctaagggaacttctgactatcaagcgaagtggtacttggatgacgtcattgacgcaaatgaggaagaagaggcagaacagaccaatggaaaggatgagacaatgatggaaattgatgatgaaatgatggtggagcaagacaatgaagaggtagcaggcgacgaagaatatgacatagaggataatgaaggatttgaagagctttcacccgaagaagaagaacgtcaactgagggaatttagagatatggaaaaggaggacagagagttccccgatgagatcgaactagagcccagtgaatctgccatcgaacgtttgaaaaggtatagaggtttgaaaaacttatacaactgtgattggcaagttgatgaaaaggacccatcatcaccagcggaatggaaacgtctattaaggattggcaattacaaaaacactaaaaacagaatcataaaggaaaccaagaatgaagcacaggccattgcaggtgatcgtattaggatgttcatcaggtttcctaagtttctgcttgaaaagattcaagatcctaaacaactattatttgctgtctacggattactacttcatgaacacaaaaatgcggtagtcaacttctctctacaaagatgggaacaatatgacaaacctgtgccttctcaggagcctatcgtagtacaatacggtgttagaagatacactattcaacctctattttctcaaggctctaacagtcctaataatgttcacaagtatgaaaggtttctgcatccagatacagtatcagttgccacatgtattgctcccgtagatttcacccagtcacctgcaatttttttcaagccatcaccaacagatgccaaaaatattgaattgattggtcacggtacattcctgaatgcagaccattcaagaatattagcaaagagagccattttgaccggtcatccattcagattccacaaaactgtggttactgtacgttacatgtttttcagaccagaagatgtggaatggttcaagtctatcccactgttcaccaaatcaggtaggtcaggtttcattaaagaaagtttgggtacgcatggttatttcaaggctacatttgatggtaaattatctgcgcaggatgttgttgctatgtccttgtacaaacgtatgtggcccatgccttcgttaccttggaatggtatgtaaagtgataaaaatatacacgtatatatatatatatatatatatataagtacgtgagatctatttgtataatataatgctaataaaatagtatcaacgatactgttgataaaggtaagtcgatacctgttccgttcgcatcaaatacaaatgccacttattttgtagaggtattaatgcattatgtgaaaattatgactttttatcaagcaaaataaatttgctacttgtgccctttttctttctttttttttttatttgatatgcgtgcctttagcatcctccaatttgataaaagtcggcttgctattagtcgctgacaataagttgtaattggtgttagcttcatttttaattttttttgagccatacaagccatcgacatagtaattatttgtaatcttagtctcataatcgagtatgattttttcaaagctcaataacgccttctttaacgcatcgcctacagcctcttttttcgacctgttataacattcacctctcgaggacaaagtaattctacctagcccaccacactgtgtgttggtgccatcctttaaggtaacctttacttgggcttctgccacaactgtatacttgacctcactagtgttggtgttttctccattatttactgcggtgaagggctggcactcccgggcctcaacatctataacatccattcgccaaccatcatacccgaatgtttcattagcgaactgaatgagagcatgccctggtatcagcttagataagttgtgcttcccatatttattattgtggtaaatattgtacgtgtacctttcgatcttggactgtagaagcccaatcctctgcaccgaccaagcgctggcaggtcttccattccaatcttcgatgatttggaactcttttatatccaagcccggtgctgtgccgtatgtagtcgaatcatacgatatgctcgaactgggcttcgcttgtatcgtcattattttgtctgtttatcctgaaatatgctcttctcctctacgtaaccctttaatggtccaaagcatgtgctaaactgccacagactccctcaatgatgttcttatccttccttgccgttactgcttcctatcatatctgcccttgccaaactgtggcttcctctaatcaatttgccccagtacattgaaaagcacgtgacgtgacaccaacttgaaagacattagtgtccaacgcgatataatggtcaataaaatacccaattttatcaagtgaacatgatattattcaatactatagtactttaaagaaaacttcaacaagttgcttcattgctatattatacaattatgggtgatgccggtcggctaacctttctttcgcagcgccacatacaagaacatatggtaattactaagaactttttggaaactatttccatgaagaaaacaaaatttactggcttctgtcttcgaagtaaatttagcgaacttgatactttcgtttggacagtcgtttagatttgcaactgtctgttcttatttcttgctattattaccagaaataaagcctaaagcgcgtggttcttacgaaaaaaatagaccttgcacattaacagggtttagacatcacagagactgaatactggagagaagacaattcttgttcacgacttcgagtgattaatatctataacaaccctcctatcaagaatggacatcattcaaggactgatacagcaaccaaaaattcaatctgtggatgaaaccattccgacgttgtgcgatcgagttgagaactccactttgattagcgataggagatccgctgtgctgggattaaaggcatttagccggcagtatagagaatcagtgattgcatccgggctaaaaccgttgctcaatactttgaaacgtgattatatggatgaagattcggtaaaggctatattagaaacaattttgattcttttcatcagaggcgatggccatgacgacttaactagaggttggatttctcaacaatcgcggttgcagaatggcaagtatccctcaccattggtgatgaagcaagaaaaggaacaagtagatcagttctcgttatggattgctgatgctttgacgcagtctgaagatttaattcacctacttgttgaattttgggaaatcgataatttccatattagattgtacacaattcaattactagaggcagtgatggccacgaggccgttgaaggcgagaagtgctttgatttcacttccaacgagcatatccacaatggtctcactcctagatgacatgcatgagcccatcagggatgaagctattttattattaatggcagtagtgaacgattcacctcacgttcaaaaattggttgcttttgaaaacatttttgaaaggctcttttccatcatcgaagaagaaggtgggttaagaggctctctcgtcgtcaatgattgtttatcgttgatcaataacatcctgaagtataacacttctaatcaaactttattccttgagacaggaaacttgccaaaactggcacaccttttgagtgaaccaatatctcaagatgaagtttttttttggaatgatcaaaggatagttaatatcaatacagctttagatatcgtcagcctaacagtagagccaggaaatactgtcaccactaagcatcaaaatgcgttgcttgactcaagcgtattaatggttgtgttgcgacttgcattctttcataatatcccaaaaaaagttagaccggttgctcttttgactgccgcaaacatggttagaagtaatgaacatgcacagctagagtttagtaagatcgatgttccatatttcgatccttcattacctgtaaactctactgcaaacggtggtccaattaaattaattcctgtagtcagcatcttgataaattggatgctctatgccaactccgttcacacgtttgatacaagagttgcgtgttctagactattaaaggcttatttcatggataattttgatcttcaaagagattttttactaaaacaagtccaattgtgtaataattcaacaaataatgtcggcgacaatgctaaagaaaatggtggttctaacaaatctgataaagaaagtgattcagataaagataccgacgggaaggatggcactgaatatgaaggttctttcaaggcaaatctattcgaagtcctgttaaattatgacgcagaattgaatctgaacccttttaaattattcttcacaactgatatttttatgttttttttccaacaggatcacaaatatagcgaagaactacgtgaaataacaagaaatgttaccaccggtaacgatctcgaagacgaagaacccttaaaggcaattcaaacaataagtgaattgctaactacttcccttactgctgctgacataagaattcctatttcctacttaacgttcctaatatattggctctttggcgactttaaggccacgaacgattttctttcggataaatccgtgattaaatccttgctttccttctcttaccaaattcaagatgaagacgttactatcaaatgccttgtaacaatgttactaggtgtggcatacgagttttcctcgaaagaatctccattcccaagaaaggaatacttcgaattcatcactaaaactttgggaaaagacaattatgcttctcgaatcaaacaatttaaaaaagattcatatttctcaaaagttgatatgaatgaagacagtatactaactccggagcttgatgaaactggtttaccaaaagtttatttcagcacttacttcatacagttatttaatgaaaacatatacaggatcagaactgcattgtctcacgaccctgacgaagagccaatcaataaaatatctttcgaagaagtcgaaaaattacagaggcaatgtacaaaattgaagggtgagataacttctttgcaaacagaaacggaaagcacccatgagaacctcaccgaaaaattgattgcgttgactaatgaacacaaagagttggatgagaaataccaaattttgaattcctcacattcttcgttgaaagaaaacttttccattttggaaactgaattgaagaacgtcagagattccttggatgaaatgacgcaactgagagatgtactggaaactaaggacaaagaaaatcaaactgctttactggagtacaaaagcacaatccacaaacaagaagactctatcaaaactttagaaaaaggacttgaaactattttgtctcaaaagaaaaaggcagaagatggtataaacaaaatgggtaaagatttattcgctctgagtagagagatgcaagcagttgaggagaattgtaaaaatttacagaaggaaaaagataaaagcaatgtcaaccatcagaaagagactaaatcactaaaagaagatattgcggcaaaaattactgaaataaaagctatcaatgaaaatctggaagaaatgaaaattcaatgtaataatttatcaaaagaaaaggaacatatttcgaaggaacttgttgagtacaaatcccgctttcagagtcatgacaatctagtagcgaaactaacagaaaaattgaaatccttagcaaataactataaggatatgcaagctgaaaatgagtctctaataaaagctgtagaagagtcaaaaaacgaaagcagcatacaattgtctaatttgcaaaataaaattgattctatgtcacaggaaaaagaaaattttcaaatagaaagaggcagtatagaaaaaaatatcgaacaactaaaaaaaaccatctctgacttagaacaaacgaaggaggaaattatctcaaaatccgattcttcaaaagatgaatatgagtcccagattagtctcttgaaagaaaaattagaaacggcgacaacagcaaacgatgaaaacgtgaataaaatctcagaattgactaaaactagggaagagctggaagccgagttagcagcttataaaaatctcaaaaatgaacttgaaacaaaactagaaacttcagagaaagctttgaaagaagttaaagaaaacgaggagcatttaaaagaagagaaaattcaactcgagaaggaggccactgaaaccaaacagcaactcaacagcctacgtgccaatttagaatcattagaaaaagagcatgaagatttagcagctcagttgaagaagtacgaggagcaaattgccaacaaggaaaggcaatataacgaggaaatatctcaattaaatgatgagattacttccactcaacaagaaaatgaatcaattaagaaaaaaaatgacgaactggagggcgaagttaaagcaatgaagagcacttcagaggaacaatcaaatttgaaaaagtcagagattgatgccttaaatttgcaaattaaagagctgaaaaagaagaacgaaacgaacgaagccagtttattggagtcaatcaaaagtgtagaatcagaaacggtaaaaattaaagaattacaagacgaatgtaactttaaagaaaaggaagttagtgaattggaagacaaactcaaggcctcagaagataagaactctaaatatttggagctacagaaggaatcggagaagataaaagaagaactagatgctaaaacgactgaactaaaaattcaattggaaaagatcactaatttatctaaggccaaggagaaatcagaatctgagttgtctagattgaagaagacatcttctgaggaaagaaaaaatgcagaggagcaattggaaaaattgaaaaatgaaatacaaatcaaaaatcaggccttcgaaaaggaaagaaagctacttaatgaaggatcttcaacaattacacaagaatattctgaaaagatcaatactttggaagatgaattaattaggctacaaaatgaaaacgaattaaaagccaaagagatcgataatacgaggagtgaactagagaaggttagtttaagcaatgatgagcttttagaagagaaacaaaacacaataaaaagcttacaagatgaaattctttcatataaagacaaaataactagaaatgacgaaaagcttctatcaatagagcgagataataaacgagacctggagagcttgaaagaacaactccgggctgcacaagaatccaaagctaaagttgaagaagggctgaaaaaacttgaggaagaatcttcaaaagagaaagcagagcttgaaaagtctaaagaaatgatgaaaaagctagagagtacgattgagagcaatgaaacggagttgaaatcctcaatggaaaccataaggaaatcagatgaaaaattagaacagtcgaaaaaaagtgctgaggaggatattaaaaacttgcaacatgagaagtcagatttgatatcccgaatcaacgaatctgaaaaggatattgaagaactgaaaagtaaactgaggatcgaagcaaaatctggctctgaactagaaaccgtaaaacaagagctaaataacgcacaagaaaaaataaggatcaacgcagaagaaaatacagttttgaaatctaaattagaagatatagaacgtgaactcaaagacaagcaagccgaaataaaaagtaatcaagaagaaaaagaattactaacttcgcgcctcaaggaattagaacaggaattagatagcacccaacagaaggcacaaaaatccgaggaagaacgtagggccgaagtcaggaagtttcaagtcgaaaagtctcaacttgatgaaaaagccatgttgcttgaaactaaatacaacgatttggtgaataaagagcaagcatggaaaagggatgaagatactgttaaaaagacaaccgattctcagagacaagaaattgaaaagttggctaaagaactggataacttgaaggcagagaactctaagttgaaggaagctaacgaagatcgttcggaaattgatgacttgatgctcttggttactgacctagatgagaaaaacgccaaatatcgctcaaagctgaaggatttgggcgttgaaattagttcggatgaagaggatgatgaagaagatgatgaagaagacgaggaagaagggcaagtggcatgatagagttaaaatatgtgcataaacaaatcgcttgaacgatctgtttgattatgtgggcagcactacttttttgtaattatatatgcatatatacattttactgacactaaatgttatattttctataacatctaacattacttcacgccttctaattaaagtatagtttgtgcaaacaatatgtgagctcacgtagacaattgtctaatatatcattaatgtcccttgcatagaacttcctttttttttctcagcgtcgcaatatctctgtcgagaaacgcttacgcattataataagccaaggaaaaatagcgaaaagccgatgcagatctacaggagtgatgaaagtactaaaaagatcagaaaagggaatatttgtcaaataaccaagtcgaaatggaaaaaaaacatgtcactgtgcaaatacaaagtgctcccccctcctatatcaaattggaagcaaatgaaaaattcgtatatattacaagtacaatgaacggcttatcttatcaaattgcggctatagtttcatacccagaaaagagaaattcatcaactgcaaataaagaagatggtaaattactgtgcaaggaaaataaactagcattgttactacacggaagtcaatctcacaagaacgctatttatcaaactttactagcaaaaaggctggccgaattcggatattgggtactaagaatagattttaggggccaaggtgattcctcagataactgcgaccctggccttggtaggacgctcgctcaggatcttgaagatttgagtacagtataccaaacagtatctgacaggtctcttagggtgcaattgtacaaaactagtacaatatcactggacgtggttgtggcacattctagaggatctcttgccatgttcaaattctgtctaaaattacatgcagctgaatctccattaccgtctcacctgatcaattgcgctggaagatatgatgggagaggacttattgaacgctgcacacgactgcacccgcattggcaagcagaaggtgggttttgggcgaatggtccacgaaatggcgaatacaaagacttttggataccattaagtgagacttatagtatcgctggcgtttgcgttccggaatttgccacgataccacaaacttgttcagtaatgtcctgctatggcatgtgtgatcacatagtgccaattagcgcagcctcaaattatgcaaggcttttcgagggcagacattcattgaaacttattgaaaatgcggaccacaattattatggcattgaaggtgatcccaacgcgctaggcttaccgataaggaggggtagagtcaactactcaccactagtagttgatctaattatggaatacctgcaagatacatagaccatacaactacatattaatctaagataagtcttgtgctgagtttggtcactttgcgggatcacccgcataaagtcgtcggcattgcagtttaagatcaaatagaggcaatactacgctgtgagacgatatttctgatcgtgattaaactggtattccacatgttcagcatccattagccgttagagataattcatttacgttccttttttctcttgcgcttgagattgttagattgttaaattactactgctttgtttttccatccgattagtataatcaacagatgaaaaaatgaaaaaaagaaaacaaaatcaacataacttgcacaagattgagccatcggaaaataaagcccattgtaattcatataactaaacatcatatcaagtgcgattggtctgcaaaatcgtgcttaacattccgagacacaacgtaaatcccagaaacacaagcatgtctaaccaaatatactcagcgagatattcgggggttgatgtttatgaattcattcattctacaggatctatcatgaaaaggaaaaaggatgattgggtcaatgctacacatattttaaaggccgccaattttgccaaggctaaaagaacaaggattctagagaaggaagtacttaaggaaactcatgaaaaagttcagggtggatttggtaaatatcagggtacatgggtcccactgaacatagcgaaacaactggcagaaaaatttagtgtctacgatcagctgaaaccgttgttcgactttacgcaaacagatgggtctgcttctccacctcctgctccaaaacatcaccatgcctcgaaggtggataggaaaaaggctattagaagtgcaagtacttccgcaattatggaaacaaaaagaaacaacaagaaagccgaggaaaatcaatttcaaagcagcaaaatattgggaaatcccacggctgcaccaaggaaaagaggtagaccggtaggatctacgaggggaagtaggcggaagttaggtgtcaatttacaacgttctcaaagtgatatgggatttcctagaccggcgataccgaattcttcaatatcgacaacgcaacttccctctattagatccaccatgggaccacaatcccctacattgggtattctggaagaagaaaggcacgattctcgacagcagcagccgcaacaaaataattctgcacagttcaaagaaattgatcttgaggacggcttatcaagcgatgtggaaccttcacaacaattacaacaagtttttaatcaaaatactggatttgtaccccaacaacaatcttccttgatacagacacagcaaacagaatcaatggccacgtccgtatcttcctctccttcattacctacgtcaccgggcgattttgccgatagtaatccatttgaagagcgatttcccggtggtggaacatctcctattatttccatgatcccgcgttatcctgtaacttcaaggcctcaaacatcggatattaatgataaagttaacaaatacctttcaaaattggttgattattttatttccaatgaaatgaagtcaaataagtccctaccacaagtgttattgcacccacctccacacagcgctccctatatagatgctccaatcgatccagaattacatactgccttccattgggcttgttctatgggtaatttaccaattgctgaggcgttgtacgaagccggaacaagtatcagatcgacaaattctcaaggccaaactccattgatgagaagttccttattccacaattcatacactagaagaactttccctagaattttccagctactgcacgagaccgtatttgatatcgattcgcaatcacaaacagtaattcaccatattgtgaaacgaaaatcaacaacaccttctgcagtttattatcttgatgttgtgctatctaagatcaaggatttttccccacagtatagaattgaattacttttaaacacacaagacaaaaatggcgataccgcacttcatattgcttctaaaaatggagatgttgttttttttaatacactggtcaaaatgggtgcattaactactatttccaataaggaaggattaaccgccaatgaaataatgaatcaacaatatgagcaaatgatgatacaaaatggtacaaatcaacatgtcaattcttcaaacacggacttgaatatccacgttaatacaaacaacattgaaacgaaaaatgatgttaattcaatggtaatcatgtcgcctgtttctccttcggattacataacctatccatctcaaattgccaccaatatatcaagaaatattccaaatgtagtgaattctatgaagcaaatggctagcatatacaacgatcttcatgaacagcatgacaacgaaataaaaagtttgcaaaaaactttaaaaagcatttctaagacgaaaatacaggtaagcctaaaaactttagaggtattgaaagagagcagtaaagatgaaaacggcgaagctcagactaatgatgacttcgaaattttatctcgtctacaagaacaaaatactaagaaattgagaaaaaggctcatacgatacaaacggttgataaaacaaaagctggaatacaggcaaacggttttattgaacaaattaatagaagatgaaactcaggctaccaccaataacacagttgagaaagataataatacgctggaaaggttggaattggctcaagaactaacgatgttgcaattacaaaggaaaaacaaattgagttccttggtgaagaaatttgaagacaatgccaagattcataaatatagacggattatcagggaaggtacggaaatgaatattgaagaagtagatagttcgctggatgtaatactacagacattgatagccaacaataataaaaataagggcgcagaacagatcatcacaatctcaaacgcgaatagtcatgcataaaatatacataaatagaggaactttacatgtatccatatactgaaaaatagataaaacaatgagataatatttattaacttctacgtaaataaaaagttacataaggatcaacctttttttctttattttcttttttttttttatttttcattttcaattacaaactaagacataacagtaagcagtgctttttctgtgcatgttttcctctttttataatgatattggctaaaataaaattaacaaaaacagatgagtgatatagattatattcattacagttcgttttcctaactcacataataatagcttcctttggaacattatcggagatagacttatgaggtaagactttaccaccgttgatgtagatttcgtccttaacttcaacgtcgtcacccaagacagtgacaccttccaaacgacaccattgaccaacggtagagttccagcctacgatggtagatttgaccaaggagtggttcttgatggtggagttgcacaaaacaacagatctggtgattctaacaccatcaccgatggtgacattaggaccgataaccacgtctgggccaatcttagcagtggaggaaatcttagcggttgggtcgatcaaggcattaccaacaatgttggcacctgtagccaatttttttggttgtctcttggccaaagagttcaagtaaagaacggtaccagacaagaagtcctttggttgaccaacatccatccagaaaccttccaaatcgaaggaatatagttgtttttcttcgaccaagattgggaaagtttccttttcaattgaagttggcttcatttcaatcaagtcaatgacttctgggtttaaaatgtacaaaccggcgttaattctgttaccaacaaattcctttggcttttcaacaaatctgtcaatcaagtttggagtagctatatcatggacaatgacaccgtatttagaaggttcgtcgaccttggtagcaacaatggtacctttaccaccgtgagctttgtggaagtcagccaattccttgaatggatattcgcaaatgacgtcggagtttaggacgaaaaatggagagttgtccttcttcaaaacatcttcagccaatttcaatggacctgcagtacctaatggttcagtttctacagagaaagtgatgttaacaccatattccttttcgtacttcttcaaagtttccaccatgacttctggtctgtaattaacagcaagaacgatgtcagtaacaccagcgttggctaaagcctcgatttggtgtaaaatcattggtctattaccgaattcaaccagtggctttggaacggtcaaagttaaaggtctcaatctggtaccgtaaccaccgactaaaattaaacctttcatttttcaattatatatgttttatttgttgaagttgtagcttgtcttgtgctgataatattttgtttgtatagtcaacaaaatatttggacagaagaaaagagttagcgaatgtaaagtagtttgcacacttgatgaacgttatcaaagtcaaagaggtgagaacaagatagacaaagaaaaaaaaaatacagttttggagaaaagaaaacaagactatgtgaaacttctaacaatgacgtgaaaagtctactatatatatgtttacaagagcgccacgaggcaaggaaaaaaagaaaacaaagcgagaaaccaccagcttactttactaccggtcagctgtggttctgtgtctgttcgtctgtttgtttgtttgtttgtttattgctgcgctgttcatgctgaaaaacgacaaaaacaaagaaaaaaaagtttttcagagattgagataaaaataaacgtggtggctcccgaggcatttctagctggccagcaagtacacggtggccgtttcttttggcgttttttttttctgttttcgcgttcttcatgctgtgcgttgctggtgaggtggcgtggacggtttggtttaggcaatgatagaaaaagctatagtcagagttgcaggaaaggacgaaagtagtccatttggtgccgttatccaagggtcttgctcttagtcttgcttttcacccagcacgcggtaagaaggatcgggtgcagcatgaagaatgctgactgtacgcgtttcgatttgaagctttaggatgttctgtgggttgggttggctcgatcgacagtgcgtatagtgacctttgaactgtaccgggtggcacgtcgtgcacagaatcagaagtagttataaaagatttgtaattgcgtatatgcaaccaagtttaggctttctccgtgccgttttttaaggtgaaatgtactcctcttgaaaatgtaaaaaaatggagcctcgcagagcagcttgccaagcaggttgatacaaggtgagccgccgaaacataacgataaacgtggtatagttttcgattgcctttagtttgggtggtctcagtgctggcacctgacgaactattcgtaggcaggagaacttgcatcatgtggtgttcttccgagatagggatgccgtttggtccttacgaaagtcaatgttctggtactactaattattaacatagttcgttgtatacacactctttactttcataagaaataaaaagcacgtctaagaaatctctacgtcttggctgcggcaagcaactgcatagaaagcacatagtagtaactctaaaatgcgagcttcatacagacaattacataaatgcaacataggcagcatgggatcctgggtttcatatcgtcaaagaaagccaccaactggctttaccataaaaatacgaaaagaagtgcacacattcttctttttggctcatcacaagttcttcaatttactgtcattacttttgtttccttgtcagataatgtatgggtggtgtgtacaccaaggtatttttttttttacttggcagatctgcaatgcataatagaatggtaagggaacgagtaacagacgggaagcgaatgcgaacacaaagaatataaatttgaaatctcctgttgcaaaggattctctagacatttactatctcagtgacaattctcgagtgaaacaagaaattgagatggtaggtcagcgcccatacttcttgaatcaattggaggagcggataaagcaagtttcccccctcaatgtaaatcatcttaagcaaaattttaaaatctaggcacatataaagagaaaatgggaatgattttgctggataggctacagtgttaggaatgcagaattaggaactatagatgatgcgattaaagatattaaacgagaagtgacagtggtggcttcgacaacggcagtcgtgctcggtcgacaacgtgtatgtttttgccgagcagagcagggaaagtccttctttctgcgcgtgaatcaaaacacattggtatcgaatttaacatatctgggtgaggaatggacaatcctaataaagtactggaggtttgtctgtatttccaagttcttgcttgtagaaactgctttcttttctcttttcctgcagcggtcgaacatatgtgattattgattagccatttgttccaagtcatatagtagtattacgtgttcagatgcggtgttagcgtatctttttgttaaataaaatatcattgtgccgttgccgccctacctgccaagggtcaaagaaggcacctttatacgatgccacctttttatagtattctactacagagtcatcgttcaccagttactgttcattctactaaattagtatggcgtgttgcatagaaggaagcatgaattacaagatcagtagaacaaaaagttcaactgtttggaatttagttgaacatgtgacgaaagctctgctactaagacaggggcaaaaaataacaatatgtaagcataagaaatgggtcaatgttgggatacttggtgaattccgttctttttagaagcggattttcttattcgtttatatgttgccattcattaccctatcatattatgaatcttcacattttattttccataagatctgatgactgtttcccaatcaccttacatcatatatgataatgtacaattgatatgaagaatagcagtcgatggatgatattttattcttattatcaacatgtacaaagtgttggaacggtaaagaccagtgcaaatctgataaaactttaaaataacatggacaaatttatgtccaggattctccgaagaactcatccttgttagctcagttggtagagcgttcggcttttaagcgcatttgcttaagcaaggataccgaaatgtcaggggttcgagccccctatgaggagttctttctttttttctctcaatttttaaccggtacctttaaaagggtatcaaaaacaatagcatagcataaaagaaataagtgcaatttattggtgtcatttatataagctatgaattttaaaaaaaataaatgtagcagtttcttttttgtttaaattctgagttttctactttttaatttccaaaatactacagctgaaagaacagcggatacaacgaatgcgatactgctgtacttgtagacagccgaaatacaggacggatttcgcagatctcctccgccactcatacagcgagaatcgtaaaatttggcatacaacatgcaaaatatcatagaacctatagcaggtgcaattagtaagctaccgtaaacagtcccgaatgagcgttcgccccatactaacaggaccagcgtcggataaacagtgaaaagtccaccgtatacaattccaaccaatgatcctgtaggtactagcccccagggtgacgctgaagaggtcattttcaataaaaacagttgtgcacatacccctaatgaaaggaaagtcaacaggatccatttaattgatatttttttcttggcgaagaagtctgccactatgcctgtgagcaatctcgtaaaagtggaagatagcgcgtatgtggataacaactttgtagataaggttggcgcatctaattggactagcaggttagtcagtgatcccatattggcaataaacatctcgaggggcccaagtgataacaaaattgataccgctaggatatatgtcacaggatcactaaagatccttagcatcgtctgcgtaaacttttcttgaacatgattacttcgttctaacagcggtgattgttccacatcagtttgatcatccagccgtttttggttgtcttgctcttcattaaaatgcaaaagtgataccacgctggtggctatccatgcaagtagcccaataacgacataaacgagggcaaatgtttggaatactcttcccaggtttaagtcactattggacgaggaagaacttgcgttagaggaccagaaccatttgattcttagcagttgagaaccgactacagaagaaataccataacatgtcgttggtaagctaatggatagtagttttgtatgaggatatagcttagtgcatgtcagtaaagcgctaaagtataaagcgcttgttgatatacctatgaaaacgaaacaaatgatggatagattgaatgatgagtcaccatttcctccgagagataactccggatgattaaaaacgtaagccagatatgaatagctaggtatgaaccctatgatggctaaaagacttaaagtaatggggccatgagaatcagcgatcatccccaagattggtggcgtcaagtacatccccaaattagtcatactagcgatggtgttgatttgccatgaggaataatttaaatgtttctgccacggttgagagtaaagagatatcaaagtaatgaagccagttgacaccgcagataatagcgaaaagatgtatgcaacacgatgtgatgactgaagagacaaaacatggggtaagagtaagcgcgtatggtatgaaaggtagtgctccacctttgatagaggcatgatttgcacttggaaaatggttattgctataaaatgatatgaaaggaaactagtctcgatgaaacgttagaagttgctgtctgagtagcggtctctgttatcttgtatttacactgtataatagtttttcttgtagggcaaaaagaaaggtactaatttccgaacgatgcgaaaagccgctagcatcggaaaggctaagtgaactatgcaataaagactaagagaaaaagcaaagaaaggcgtcttaacacagtatacatttttcgacattatgaattataaaatttttatttacgcttgtaaaataatattttcatttcttctattttcctcttttcttcgttttcttgacttcatacttcattttttgtttgactcctttttgcgttatgaaacgtgatgcttcgatattctcattggtttcttaaaactttagcaatatcggacaaacagccgtattttttattcttatttttactgcttgatacagtaccccagtcagtggctgttgaaactctgccacttgccgtttctgatagtacttgcttataagttttcattgaatgacttttttcaccagcggtatagctctgaaataatttgtgcatatacgatctaacttcttctctattgtaaggttgtttattcgctcttttaaatttcttatttgtggatgatccattggcggtggaactaccctttatattagcaggcggcgcggtagatgcgatggttttagtcttcgtattagcaggttgtacagccacggaatcatcttttcgtgcctgctgttgctgttgctgttgccttggaagggctttggcagctgcctgcgcccaacctgttaattttggcttctgaggaagcacagcgggcgttggaccatttgaatttggacctgaagcagataaagtagccttcaaagtcgaggaggttctgccatctacactggttgttgaggttgttgtcatttcgtactagattaaagggaaaattgtatcgtaaataagtaataaagttaatgaaaattcggaaacaaaaatggatagatattaaacagtgaacaaatgaaaaatttcagaaaaaaagaattaaaaaaaaaaagggaaaaaatatgcacaagatcgtattatttgttgttcctcgtatttttctttctatttagtctcacatttttgacacatgcctggtgttatatatacattacaatggaaagttcttttctctttctccgaataaagtagcggtctattgatcacttcttacgctgggtatatgagtcgtaataaataaaatcatcagaatcattcgtaagtcattttacttttttaaaaagataattacagtttttgggtctatatactactctaaaaatgtggtggtggcttaatgcatcttttttacagatgaaccttcgttatgggtattgacatcgttgctaatgctgacagaaggcacaggctcattcttgattttcttgttcactttcttgtcatgttgaagagcggcatactcaatagcttgtggtgggagggttgtatcgttgatggcgggagagtagccaatctccttcaaagtgtcaaccatttgatctctaactttttcagcaaattcaccaattttgtcctttgttaagttctcggttgaaataggttttaaaattctaacaatcatacagcctctgttgaagaccccatatttaggacttactaaagtactggtattggaaacaaccactggaacaatggggatcttaccctgttgtgccaaatggaaagcacccttcttgaaaggcaacattgtcagctcactcgtgtaagacctggtaccctcaggaaaaacccatagagcacgcttgtttttcttaacattttctaaacctttattcaaggtgtcaatggcttcttgccttttagatctgtctaagaaatatgtaccactcaaagccatgaaccaacccagaaaggggacgtatttcaaagacttcttggcagtaactgtgcaaccaggggggaaaatcctacctaacatgaagatatccaaggtggattggtgattggcaatcataatatatggcttcttggccaaattctcctcgccaacgaccttgacgtcaaggccaagcatcaatttcatgacatggtaaaaacaacgcgcagtaatccactgagccaaatgttgcttaccgattaacgtgcaaaggatagaggcgattacaccgtaaaagccacagcctgcaagcgccagtacgaccaacacggacctcaagtaatacaagaacctacctatcacactcattatttttttgctcgaattcactgacggagggaaaccactaaacttctctattgaagaattcccccttcaccttaaacccttcctaatataagtattttgaacaccataccatattctcaacaaaacaaaggaagcataattgatatcatcattcacgagatccatctcgtgaccgtgaaaaaattttcgtcttcgtcttagtgtaatgtgttcagcccaacctcatcgcaatatctcaagatttttgaattacaaccaaatcaaaagcacagagtcgcatctcatcgctatgatgtatttttttctttttccaaaaaatgggttctatttggttctactggaactaaagtagcatctgcaaagaagtaatgtctgaaaaaccacaacaagaggagcaagagaaaccacaatcaagacgtaattcatttgctgtgattgaatttactccagaagtcttggacagatgtttaaagcaagtggaattctacttttctgaattcaactttccatatgacaggttcttgcgcacaacagcggaaaaaaacgatggatgggtccccatcagcaccatcgccacattcaaccgtatgaagaaatatagaccagtggataaggttatcgaagcactacgtagttctgaaattttggaagtatctgctgatggagagaacgtcaagagacgtgttcctttggacctaactgctgccagaaatgccagaattgagcaaaaccaacggactttggctgtaatgaatttcccacatgaggacgttgaagcttcccaaattcctgaattgcaggagaacttggaagcctttttcaaaaaattaggtgaaatcaaccaagtgcgtttgagaagagatcacagaaacaagaaatttaatggtacggtcttggtggaatttaagacaattccagaatgtgaagcttttttgaaatcgtattccaatgacgatgagtccaacgaaattttgtcatatgaaggtaagaaactgagtgttttgacgaaaaaacagtttgatttacagagagaggcctcgaagtccaaaaacttcagcggtagatcaagatcctttaacggccataagaagaaaaacttgcctaaattccccaaaaataagaagaaaaacggcaaggaagagtcaaaagaggactcttctgccattgccgatgacgatgaggagcacaaggagtgattcttgtgtttcttctggttctcgtatctcattatcatagcatattaagaatatatgtactaacatatgtactaaacagaaacacaatatgaattacaactaatactatattatttgtctcctttttttattagtattaaaaattaccgttactggttaaaatggaatacagctcatccatttaaaaaaaaaaaaaaatagaataacaataattaagcagaaaaaatgttaacgaatataataaatcgatttgtccattttcataaattttttttttgtattatttcattatctgtgcctcaaagcattaacttttcttgcagtcagagagagtctcttgcgtggattataccaaccgccattatcagccggcataggggccggcgtagcatagttactatcagctgtaattatgtatgaccaccctggtgttacggtagtatgttgatcaacggagtttcttaaagtgtagtaatacgttacctcactggtcgcgtacttccttttccatgtctttgctgttaccttagtagccggttggagttgcatgggagcatatttcacaacacctgtttgtaagttgtagggaacggtgaaactcttagaatcaatcgtggcacccacatctcctgtggtaattcttgtttgtgcctctggtgcaatggttatcatactcggattagcggcttttgtaccaatcatcccttttagtttaaatctgttagtgtaatgaatggtgtaaccgatagctgtttgcgcaaagacttgtatgaagtaaacaccgtccgtcccaacggtgttttctattatcgcattgaactcgttgtctgtcagatcactcgcactgagtgtttgaagagtagccattgcttctatcatggcattggtacccgaacacagagtaaacgtgtatctgacaaaatccttttcctgtggtgtgttatctgtatgcatccactttactttgacaacagcctgacttgtaccagataaatcataaactgagttgggttctggagccacaatggccacatcacaataagctgttcggaacactaccgaacaaaataatgttaagaataatactatcagcatacgttttacgtaattgattttttattattgttacctacctaagaagtcgacgtaatacttgtatactttactttttacttctgtgcaactttcatcgatacgtttttataaatttacgtaactaactacctcatgtaatattatacatgaacgagcacataatgtccaatgtcccttacatgttcgtactttcaaaaaagaaagaagaaaattggtgaagaggaaatgtgcttttctgttggagttggtcaacaatatgatgaggaagaagggaaagccgcaaagactggatttacgcaatggactacattctcatgtgaaaaaaagaagtgctgcttcgaaggttcgcgaccctttcaagggactcgccgcgatgcagagaaaaaaaaaagaagagataacgtgggggcagctaaaaaaagacgaatcgataatgagtccatgacttgagccggacggacttataattcgattcgggcctaggcttgtacagctgaaatagtgtacaatataaggaactaaacgatcggagaccaatcggagagccggcagttgaatcaggtgcttcatcactggcataacctatccgcaaacggctgatgcaggtctcaacgcccttctggtaaaatcaaaaaaagtaaaaaaaacggctcatgccagcttgcttcctgtcaatagcggttgttgattttttcgcttcatgcctaaaaagagaaacgagacacagagagaaaacaagaatctagattaataacgtagggcagcgtaacaataatttacgcagaaatgatgtgtattattagggcataaataaataaatgtatgtatgtgtgtgtatgtatgagtcggtgaatgactttggttttagtgatatgagtagccacatcctttccccacgtgcttatttagccagacgtcaacgttcggaaattgcagtccacaatgcttgcacttccccggcacaacacctctatcttctttcttggtcttgggcgggtactcgaaatgcaaagcctttaggtgattcttgaaagtatcacagcgcgaaaaaacgcccgtttgatgacagtttattggctcgaaatagagtgatctagacttgtgtggatacacctccatatccaaattgatcagagtagagttgtaaggacacttgaatgcacctttaatcttgtatagtgatttcaattggtttttcttcagtagttttgtttcttcggaagaggatgaggcagcgagtttatcgtttgagtcgtcgctgtcgttgtttgcggaggtgcgggcagtgtcatcttgatcgtcagcaccactattgttgtcggactcccttgcgtatatttgcataaattcatctttccaatggcgcttcttgtgccttatcagatcattgttcctggcaaagccgcgttgacagatagggcacttatgcggtctgtcctccggagttaaatgagtggatttatgcgtagataggttggcgtagaagttgtggcagatggggcattcctttttctttctttgcttcgttatcttggcggaatcctttaaagacgatgaatacctgcttgtatgttcattagtcaatggggaatgaatagacggtagtgcagaggcactactactactgttgagttgctgttgctgttgttgtttgacgatcaaaggtgggaatccactaacgggtaggctggacacggattttgatctcggtacgttatctaccgcggttggcaatatactctggtgttgagttggtggtgagggggtgatggttttgaaacccgttgtgttgttagggttgcaaaatgttagctcatgtctgtgatgatctagcactgttcttggcaccggtgatgtaaaattggcatgcaaggaatttgatctgccgttaaattctctttctgcaactgtaattaaattggtgaaggaggatatgggtggcaaaatgacatggcttgagctgttggatgacagcggtgttggagaaaggctatgagggaaatagcatttggaattatgtgccaaggctgtattgtctgtaggcgaactcgtgatagactggcatgcagaggagttataagaagagtatgatgtagttaatgggggaggtggaggagaattcagtgtagaactgagggtagagcgcgaagacgacgtagtactggacaacaatggcagtgatggatctatcaaatggtgaatggtgccattgggagaagccgttgggtttggcattttttctggagtatctataaagggagggtttctccgtaaagacatcgtctcatgggacattactgagtcaatgcttgatgcaaaagatgatgataccagcatcattactgagtcaatgcttgatgcaaaagatgatgataccagcataggggaagccaaagaaaagaagtaacaaatattccaagcgctccagtgttacagctactgcaaaccaagaaaagcaactgacaagaattagatatcctaatcatagggcaccgaatttacttccatgttttttccagctccacttagaatatatatataaatgtataaagacggaaatatgcgcttttgagaaatagacagaataaagaacgcactgatgcagctttaacttttaagaaatggtgctttttttttcgccctctgttcctctgcggatgggagctatcagtagtagaaaacaaaaggaaacgaagaaaaaaaattggaaaagggaagagtaaaacagcgaggagagcattacgtacataaaataggtttaagtaaccataccactaacaatgcccctaggaagtgacaatctagagatatccttgagagttagccacgggccgtaagggaaggaaaagaccaatctagcaataagcgcatggggggtttccgacagccactaccaaattgtgtggcagccaagcgagaatcaatgcggctatttgagatctgttctttttctattcaaagactcgaatgaggccaacgaaagaagtagtaaaaaaaatccgggattcccaattcaggtcatatccggcaagacattcccggattttattttcctcaatgtgctcgtgtaagtgtcggcccggaacttgattccccccggactaattagaagttccgagaacgcgcgcaagccgtcccgcgcgtagaaggctaaaaagcagccggaggaaaaaaaataacgcaaatgtgggctccccttcccctgtgcggccacgtcgtgcctccccaccatttgcctcatatgcggccattgcgtgtggtgttttttctgctcttgtcactgattttaactaccgcggggtttgactaacaagcaaattgcaaagccgcggcgttcccggaaaaaaaaaaggaaggccacgctattggtaaccatgaagtgtaaggcgacgcaggagagatgaaaagaatgaaattaaaagaaatccaaaaaaaaaaaaaaaaaaaaaaaagaaaaagaaagaaaaagggggaataacacagccgcgggtaacatgaagcggcgcgagcgatacttccgtgttaagtgatatccatctttctgcgggtaataagtctagtcaagtccgctgtattttttctttcgctctcgctctctttctctcttcgctcatggagcggtaaaaaaaaaacatgcatatcgagtcgaagcccagcaaaattaaaaaaaatatagccttcagtggaaacccagtgatgctcgcacacaacgtaatggagcattgaagagctacagacggtagataaaaaagaaaaagaagcaatacaataggttattgcatactatcataagcatacagataaaggagttctgcacatacggtccctctttctcttcctattattcttcagtcccctcctcgctctttttagattcgacattacaaggtgaaatactattgaagctcaaaaacatccataataaaaggaacaataacaatggtatctagaggccccgacgaatggcttgaaacaataaagaaatgccaggcgctaactgaaaacgagatgaaacaactgtgtgaaatggtgaaagaacttttgatggaggaaagtaacatccagccggtacagacccccgttactgtatgtggagacatacacggccaatttcatgacttgttagagctattccgtacggcgggtggctttcctgacgatataaactacatttttctcggtgattacgtggatcgtggctactatagtctggaaacttttacgcttttaatgtgtctgaaagtcaagtacccggcaaagataactttggtcagaggaaaccatgagtccagacaaattactcaagtttacgggttctacgaggaatgcctgaataagtacggatctaccaccgtatggaagtattgctgtcaagtttttgatttcctgacgctggccgctataattgacggtaagatcttatgtgtccatggagggttatctcccgagattagaatgctcgatcaaatcagagtcttgtcaagagctcaagaagtgccacacgagggtgggttctcggacctgctttggtcagaccctgacaatgtagaggcttggcaagtttcccctcgtggtgcaggatggctctttggcagtaaagttgctagagagtttaaccacgttaatggactgaaccttattgcccgggctcaccaactggttatggaggggttcaagtaccattttcctgaaaaggacgttgtaaccgtgtggtccgcgccaaattactgttatagatgtggtaatgtcgcgagtgtaatgaaggtcgatgaggatctggaacctactttcaaaattttctcggctgttcccgatgactacataagagaatccacggcaaaccataataatcaaagagccggctatttcttataacacgacggcatgccctccctaactcgacgaataaaaataattttcacaataaaaaaaagactacaaaaatcagaaactttttcattacgccatttgctacgatacgatacacaacaagcacattctaagagcattccatttactatggtcaaaatgaccaaataaaaaattaaaaaaaaaaagaaggaatgagaactagtaactacatattcaacaattgcagttttcttttcctttttgtccttgtcctttctttcctatttatatatatatatatatatatatataatactactatgttatattacattatattattatcacaataattattacgttcatcgtgccgaaacgtcacctcccacggtttggatctattgaaagagggtggaatccctgataataaaaaactttaatcaacactcgggaggggaaatataaaagactggcgctacttaaagagctgattcgccaaggcagaaaagcataaccatattaaatcttctccttcaaagctagcacgccttccaaaatgacccacagcttgaaagctctattcgccttgctatttctttacacagctgctgtcaatgcgggtgtgattggcatattcaacgcccttcccccaccaaacaccaaaccaattaacggcgaatctccactttaccaatgtgacattctagacaagcaacttgtggaaatcaaagaggtcaatttggaccctaaccctcctgttcgtggcgaaaatttgactatttctgctaacggtgaggtctttgaaactatagaagagggggcatatatcgacgttgaagtccgtctaggatacatcagactgttatcccagacttttgatttgtgtgaaacattagaagataacgatatcgaaggcttatcctgtccaattgaaccgggtgaatacaacattaagaaaatagttgagatcccaggcgaggttccacctggcaaatatgttgttgtagcaagagcttacactgaaaaggatgatctgatcacttgcttaaccggagaagtcatcttcccaccaaggtgatctgattcatacaactcattgatccgtgtttatttcccttctcgttccatgtattcttttcttttaccccatgttctcttcacccgttcgaggcagggtttttcctctttttgttataaccaccatctagtcgaatgtggttactcttaatatttttttgtcggccaatgcttcagcgcctttgtcaacacctacttcttttccattcctttcctctaattaaaaatcatctatttagtgtgtacgtattaaaaacatgtcattacattgatatctcattgcaaaatttctcccttacgcacatctttggttattatatatgatgacaggttcgttctccgggtaatgcggactttacatattaattcttttcccagtattttaggcagaatataaaagctttgaggctttaagtgagacaaaagtcttaccatagcaacacgagggctcgccgaaacttccatctaaaataaagagtgcccattaatgtccggaaaaccaccagtttatagattaccccctcttcccagactaaaagtgaagaaacctatcattaggcaagaagcgaacaaatgtcttgttttaatgtcaaacttattacaatgctggtcttcatatggtcatatgagccctaaatgtgctggcttagtaacggaattgaaaagttgcactagtgaaagtgccctcggcaaaagaaacaacgttcaaaagagcaatattaactatcacgccgctaggctgtatgataggatcaacggtaaaccccatgattaattttatatccaaaagcagcaagaatgaaaacttgataatattaaagtcatggccttgtatatacaaattaaatagtctcaacggaaaatatataaacttttaatctaatagtaacatcagcattttattttctttcctccgttaaaccgtacttaattcttgatcctgcctgctctctctaaagtgtcatcaaccaaataccagccaggatagtaattgtcatggtatttgctgaatctttccttatccaccacggaaataggtgacgtgtttatagcggaactacgttcgccttctgcgtccttgccaaatgcatgaatgatttcccattcaaaatgcaaggctggattattggagtcctttctcaagtgtgggttaggcaatgagttgttaattccgccgattgatgtgaaacctttaccatatagtccacaaattggctcattagaatacagtaagaaactccatatattggttaagtcccagtgtaagagaggttgcaacctcataaaatcaggccagttagaatctgttctttgaataggctttaatgcttcaccaaatgggtctgtgtgtctaatacctatcactatagcttcggtctcagggtatatctttataaaatctctaaatgcgtctgccatattgaccgatgcaccagattgcctttgtgattcgtataaggaaaggcaatatcgctctgaggtttccagtacaaaattctctaatgtagggaaagtttcttcttgatcaatgaaaacagttggaagtctttgcatggggaagctttgaaactcgaaatcgaattgggaattttgagccttaatgaagaaatattcccataagcaactcagatataacagtagtaatacctggcaatcttttcctccgttgtacgagaatgatatttccccattcagtggactccaacgtacaaaaatttcacttagtaagtattttcttgtcaaccgtatcgcttcttgtgtacttgctattatctgagatttctggtctatgtgtaagtaagagtttgttatctcataacacatctcagcagccttgctcaactgcatattgtgctcccctatttgtttattactttttgcaaatgttgccctctataccgagaaagtaatatcagttttttccactctcagtcaacaaaatctttcgaagatttttcgaggttctttctatagacggatccttaggttcttgctaaccaacgtgttgtatatgaaacccatctccaaattttgagctcttcccatccttttgtttcctcggactcaatgaatttgaaatctgccgaacaagctaactaaaaaataggaaaattggaacagaagttaaatgcgagcaggaacgtttattagcgcttttaagtctaacacatatatataacactatttacaaggtttgaataattttctacctgtctctagttaaattttttttgaggcttttgagataattttcaacaattagtaagtcattattcgtgtctttattccataaaacacctacattcactattttatttgcgctggacgaaacttcctcatctgcactgagctgttctcctgcttcaagaaagacatcctcatttaaacttctcatttctttgacaatcttatccaatatatccacggtttcaatatttccgatgacaccattaacgctcatctcggtaaccacacgtctcaagtagcgaatctcctggaagttttcccacaatagctgaaccagcaaattgtagaaatcaacattacaaattgttaggtacagtgaagcgtccatgttgtttttacattcattataaacataggagatcaatgtgtactttctgtctgccgggaaatcaaagtcacctaatctaagcgatttgactataatatatggtaaagtcattgcaagcggtttcggtagttctgccggtttatttatacacgcacttctaatgtcttcgaaaatgtttgaagattctgcattcatctttaactctaggtctttgttccttttcttgtaaatgtctagtgattgctttaggtatcttaaaagatcgtaatcacttttaacagcttccctcaagtagtcaatgtgaggttctaaaacctgatccagtgtggtttggtaccgaatcttattaccaatttcttgcatcacttcctcgctaaatttgacgttggaatgtgcaactggctgcctcaaagcttccattcccgagcccttgcgcagattaagattcagcaattctctgttgcttttattaatgctattatcttcgtcaaatatcttttccagcaaagttcttgtctgctcacttatcgttttagtgctaatagcagaaggttctgcccgttcgtagacatagtcattgcctgctgtttccttcaggaattcatggtccttatttggaagcttcctttgagctctttgactgtggttaaaaacaattttttctttttttacactagttccctcggagttgtcctgtagcccattgtaatacttgtcaattattttgctagcattagtgtgcctcatgttttcaacccttgctccagcttcgaatagttctccaaataccttacgttcctcttcgagagcttgttcaaatgtcttttcatttgaaactctttctacgttgtgagtttttctatctttcaaattggcttcattcagcaagcatctatggatgcaatgtatgtatctatagttacagttttttaatatagatgatgttctgatcattgtatggcgtgttgtactcttccttagttccctcttcttcctttacaattatctctcaagtatagcaagcgttgtcacatcacagttttcggccttgttcgcctaattacatttttctgaataaatacgtatgtatgctgcgagtactagatactgttgataaatggtaacataaatactctagatcgcaaaagcgcatggaagttgagcagtaatataattttagaggaatatggttattatactccctgagaataagtgcacattggatgggaaaatttcgtaaaaaaaactcttgtaaagacaattgtttccttaatagctattatataatccaatttggttagagttttgtatgccgattattaacgttacccaaaaataatactgtcatacatcggcttgttcttgttcggcttgtttaaagaaaaattgaacgtaataaagttttgatatagcatcccaaaatgtacactttttatttaattcatctactccatcgttattattgtccatgtcattgttttcgctgaataatatttcgtttggaggtagctcaatagcaatattttcaaagggttcatacgcaataacgagaaatttttttcccttctgtttggtatctgatagctctaaaccagatacaatcctaatgagaggagggactttagccttatcatcgctatcgacactattttctttgacttcactgctataatttacctggatagccaaacctactgaaccgttcttcgggtttttcacggtagctattttacaaacagggatcgtaccgttattctttaaagattgcttagcttcaattatcttttgttgttgtcggaaatcatgagttgtttggccttctctccctagagaacttttctctatactgataccacgccttaacacatttaaaccatgttttttaccacccaaatgcctttcaacgctggaccacgacatgtgcattgtattacatagtttacaaaccagtttaccggaatgattcttgtaaatgtacggattggaccttacttgatcgtccttttcatcttggaaagtgtacgggacattttcgcctttactaagtaatgattcgacttctttccttcgttgtaagttaaactgagattctgaggctataccaccacctcctttctttgacccaacgccttctaaatagttcattttgaatgtatggatgcgttaaatgatttgaatttgctgttccacctgcccttcttacattaagctatttgtgagagccttgcgtctttagcagatttttttttttcatttttttagtgagatgggcggtacatgtaatatttcacccggtacaatgaaaatagcagaatgtaaataatatttgactacaataattgaaaggaaaacaaaattgtttgccatactatgtaaattgatattaatttggcacttttaaattattaaattgccttctacttagagggttttgggatgttcatctgatgtaacgacatacacgcccttatccttctcttggcatttaaagttcttgttcttcaaatcgttccatttcttatgcggaatcgtccagccacatttttgggctaccatagctgcaatgtcatcacagtaccccaaaagagataaatcaaattctgcgtgcttgacgggatcacgattaatcaggacttggggaacgtgggaaggaaccatgtttacgatttcagacactggcgctacttttaaacttgtcccaatgcaaatcaacaaatcacattctaagatatcttcgcgaatgctcttatgaaatttatttggcagtgcttcgccaaagaatgtgatatctggtttgagaacgccatatgagttaaggatatatggaggcctttccgacattgaaccctgtgatgcagcaacacctactttattattatatccctctgggaaatattctcttctttttttgtaacagtacgggcatagtggaagttcgaggtttctaattttattaaatatcctctcaccgggtaggttccaatggcaggtaacgcaggtggcagtagcaaaagagccatggcactgcaccagtttatctgtgcttattcccgcataagattccaaattatcaatgttttgagtataatttctcaataatttccctttcatttgtagcatcttaatgaaactatgcaatggagaataaattttttctggaggtaaaaccatattggcaatattatagaaaacagaggggtcgtgcataaatatattgtaattgaaaacgtcttggggatcatcgagccccaaatgtttgatctttgaatagaacccctcagaagatctgaagtccgggatccctaatgaagttgaaacacctgcaccagtcaggaccaaaatttttctagcggtatgtaatttttgaataaaatgatcaatagtgaaaaaattggataatcttaatcttgtacatagaactttgttaattgctctttgcaaatctttgattagacgaactgtttgcttttttgccaatgggtcttcaacatttgtgacagatattgcacttcccaaatcttgaacacgctcttgcgagttgatatggacaatactgttgatggtgccgataagcgcttgatctttaacttcaaagcctagcaacttgataagatagtaaatgtataacgagttcaaatcctcggggaggtaagtgtctaaaaatttgtgtgcaccatagtatttcagaaacattcgagcattgagagactctcgtttagtgaaggagggaccatagaaaataccatttgatgggtttttactgattatgattggccccttgggcgtctctggtttcaaaacgtcattggacattgacactactgaagctgctgacactgccaagggatccatgtcattagttggtttgagctccatcgatgccacttctccgagcgcagctttagtgtgcccaagtggatctgttgtgttggtttccctcaaggaatccggctgtgctacttttatcttcttatgtgaaggttcatcattatttataatgtcatcgggttgttttctgatcgcgtctttatcttgtgtggggcttactgtatttgaaaccttattttcgctagtctttgatacggcgtatttcatatgtgggatggtcatccagctttaatgtgccgatgagggaaaaatggtttgaatgtgtctaccgaagcgatgcctaatttcttgaaatacgtgagaatgggctttacatctcttcactaaatatatttttcttgggtggtgaaaaagacaagtctttcaaactatgcgacctagaaaaaaaatattttaccgcaactggcggccaaagaggacaaagaaaaattcctcgttttttctctgagatgggaaagcaagaattttggcaagaaaaggtcctggctgtcctggaccatggttggaaggagtgctagatgtagcttggaaaagaaatgacctataacaatgtatcttttatgagcatatgcgcatgcatataagcatatacataaaaaatatatacataaattaagtaagagttaattgacacattgaggagttgcaggctacaagtaatactgtagaatttcgttctgggagtgaggctccaagggagaaagactgctaataatcatttctttcaaattagagcttccgatcggaacatcatcgcgatagcgatacagaaatagcaggccatttatatcattcttaccgaatttttcttggtagaaattcagccaatcgaagctattgttagatatttcgtttaatgggaaattttcagaatactctttttcaaggctcttcgtgactactttcttcaaaattggatcaaagggggtgtcgtttcttgtggcatgtaacaaaacaatggccatactaccaaataaaccgctcgtggtgccaaatctcttagcgaatttgtttagagaagcaaagcacaaagctaactttccaattctgtagttaaattcaaagtccaaaatataatccctttcgtcttctctgacttgcatggagtagttattataaaattcggtagcgaagtcctccattggagtggaggtttcaatcaacttttcgccgaatacatcgttatcttgatcactcggataagcagcaacactcttggcttcagtttctttccgtttgttcatagcggctgcttccttcttagcttttttcttttggctgctactattttggccattattttggatttcatctgaattttcatctaaagaatcggactttctttttaagcgatcatcatgcatttgaaagtaaagctttgatgcttccttcattgcgcgaacatacatgggtttggtataaagtgcctttccccattctaacatctccagataggctcttggcgtaccttttctcatacagtatgaatggaaatccaactggtcatcttcgaattgtttataaaactttggaatagcgttgaatcttttcagcgccaaacctttatatttgcgaacaagccattggttttctttgatatcattcgcaatttgttcgcttttatcactttcaacctctttttttagcgatgctaaatcgtctaatttcttttttctatccaggtatagtctataataggcttctgcctgttctacgatgaaccaagaagcttccacaaggtgtaagtccttaataccattaacagaatcatcgtttttggtgaaaagggacgcgacttccaccgccttgtcgatattgttagcccttaaaaagtacttaaccgttttacagttgataaatctatcctgcaaatcaagttgcctaccttcctccaaaattccagccgctgtgtccattaggcctaagtgcttcaggatacgtgccttgaggatgtaaaactcaactaaagttggggtgtggtcaagggcagcatcaatatattcttgggctttcggaaaatccttaaggaaaaggaaatgttgagacaagtaataattggtccaaataaaaggaattggatcctgcgtaggatctaatccggacaaataatcaaggacaattttctccaatagtggtgaaaccttggacttccttctttggtaaaggggtttcacgttggaaaaagttgctggaacaccgcgctccaattgaggcaaaacatattctctcaattttttgctgagctcttctttgtcttgaaggaaagttaatggaataaatttgggtggttcgcatcttggataaaattgttcaagttttccatacaaagccttcttcaatttattgtcaccttggattcccaaggatacttccagtaatttgtagtacttaaaattatctggatttctcttgatcagagttctataaacaatggacgcgtctttcaattgacccaatttcatgtaaatagttgcttttctctctaataaaccaaatttatcaaagacgcatggctcgatatcattcaaatgtttcaatacattttgtaacttgtcttggttatcactggcagctttatacataatgtcgtttttgtacattaaacactcgctgtgttcatatttctcggaatcagatatttttccctcagcgagtttttcaaactgagataaagtgttaatagcttgttgcctctcaccgttcacatcttgtgccacagccaatgatgtccagttggcacggtaaccaaggaatgcttcccaatattttttcctggacactaaagcatttttgaaatcgccaatttgtgattgcaaagttgctaagtctctatatatttgcttgttagtggacccattgttcaaagctgccgtgaaccatttaatagattctttgtactctttggtgtttctcatgtagatacctaatacatgacagcagattggtgatgctgaagcgccttcaatttttctgatggcattagccacgtaggaagcagcgtcatctttctcacctacagaatataaatcaagaccctttaaagccaaggaatcaacgtgactaccgtcttttttcaaaattgcgtctagcagcttgagagattttttgtattgcttcccttcgtatagtttcaatgcctcgaggaactggtcattttcttttttcaaagctattttagctgctggcttgggcttagtacttcttttcctagacatacttcgttagggtcaatcgccttcctcaatggtatttgtcttaaacaaggaatctgaacatcactttttaaaaaggtttgacttttgagtgtagaaactttttcattttcgctctttcctctttactctgtattatgttctgtttcgacgcggagcagggtaaaaagtgcatacgcaacccagcgacctcattagcaaggtcatgcaatttggtggcacatttcaggcctatcatgtctccagttgtacaataatgaaaatttagcagtattccccctttaaaagattaaatagcgattatataatcaactcaaagagtttccttagcagtcctctctcaattttgaattgtcgaatgtcatggcgttctcgaagcactttgcatacttcaaggagtggacagaaagagtctgataataataatttttttattgaatccgaagatattctataatcaaatttaactattattctatgtaaaatctataattggtttatatggtatacgaacgagaatggcgtagggacatgaaagatggtagaatgactaaatgaaagctagaggaagagcggcagcgagccacaccaattttcctactgcttcaatgtttgcgctgccttccatgattaatgaaatgctggcagatgatgtaatggctcctgttgatacagcagcaatggaatgctttgatgtgataaatgcgttagtagtggtggtcgtgaaggaatttgtataatgaatggcactggattgactagaataatctttagttgaggtaccagaaacactttctagagaggcagctgcagaaatattgtcctcaatactgtgattcattacggaagcagttgattgaacgttacttatagtagacgttgatgcaggagaagtcataaatgcagattgtttggtgatggtagtgtctttgggacccgagtaatttggttcccaacctcagactgaatgttaatgtttgaagttactagtgttgtatggcgagtcgagtcagtaactctactgacaatatcggtgacgcttgcgtgagctgatgcataagttctatctaatgtgattggatgagctgaggaagatgagccgactaaaccattttcactggctagagtcgttgggtctgctgaagttatgctaggatatgaagatttagttgattggaatgcgtcaactacagaaacagaactttgggtcttcgaatcattgctgctaactggcatattaggcttgattatacttgttgcgcttgacctactcgaggaagccgaatcaactggggttaaagttacaatcgaagaacttgaagtggccgaaattccttgctgtctagaaaggcttagactttccgacgcaattggaatgcccgtggaagttgatccggtcgaagctgttggatatactgggctattcgagacagcgaaagtgcttgggtctacttgagatctttgaatggatgagacgctcaaatcagctgaaccagttgaggaaaccatatcagttagactagatgatactgtttgggtatcttggctggttgaagtggttgaaacccttagaatgattgtgtcagagaaagtagctagatctgttgaagtagttggaccacttggtctggttgaataaactgaggttgaactgacaataaaactggttggttcagatgaagttgaactaactacagaactagctggatcaattgaggcgctactgatgatagtagttgcaccgcttgaactaacgatggagctaactggatcaattgaagtagtttgagccgctaaagtagctgaaccgtttgaattagcagaaatagtcacagtgcttgagctagttgggtaagatgaagttaaactgacaacagaactagccggatcaactggagcggaactgactacagaactagttggatcaactgaagtagtttgaacggtcgaggtagttgagtcagctgaagtagttgggtctgctgaagttgaactgataacagaagtggttgggtcaactgaagtagcaacgtcacttgagctagtttgatcaactgaggttgaaatgactacagaagtagttgggtcaactaaagtagtcacagcgcttgaactagttggatctgctgaagtagccacgtcacttgagctagttggatctgttgatgtggttacctcgtcagagcttcttgtacgatacataccagcaacacttgatgaggcatgtggaccaactgttgtagtagactcaattaaagatgtagagtccgtggaagtggaaatcacgacagagatatttagacttgttgaagtagtaatatcgtttgaactgacgagagaagtagttggttcaattgaagtggtttgaacggttgaagtaatcacatcgctcgagctagttgggtcaattgaagtggaactaactgcaaaagtagtggaattggccaaagtggaattgccgatgttgttacttggaccagctgaagtggtttgaacggtcgaggtagttgagtcagctgaagtagttgggtctgctgaagttgaactgataacagaagtagttgggtcaactgaagtagcaacgtcacttgagctagttagatctgttgatgtggttacctcgtcagagcttcttgtacgatacatagccgctaaacttgatgaggcgtgtggatcatccgatgtagtatactcaattgaagatgtagagtctgtggaagtagaaatggtaacagagctacttggatcagctgggctagtttgaacggccgaagtagttgaatcagctggagtagttgggttaattgaagtagtcacagcatttgaactagttgggtctgctgaacttgaactgataacagagctacttagatcagctgaacttgaactgactacggaagtagttggatcagctgaagtagtttgaacggtcgaggtagttgggtcagctgaagtagttgggtcaactgaagtagttggatcaactgaagtagaactgactatagaactagttgggtcaactgaagtagttggatcaacagaagtagtttgaacggtcgaggtagttggatcagctgaagtatttgggtcaactgaagtagttgggtcaactgaagtagtcacagcgcttgaactagttgggtcttctgaacttgaacttactacttaagtggttggatcaacagaagtagtttgaatggttgaactggttacatcgcttgaactactagagtcacttgaagtgaaactgctgaaaggactagttgaagctgctaatgtggtgacatcagtagatgttcttgaacgataaatatcggctacgcttgatgaagtatgtgagtcaacggaagtagtaaaatcaatggatgtagtggaagagcttttcacagtagatgacgtagtagtggaagttttcgtagaggatgaagtagtagaggatgaagtagtagaggatgaagtagtagaggatgaagtagtagaggatgaagtagtagaggatgaagtagtagaggatgaagtagtagaggatgaagtagtagaggatgaagtagtagaggatgaagtagtagaggatgaagtagtagaggatgaagtagtagtggatgaagtagtagtggatgaagtagtagtggatgaagtagtaatggatgaagtagtaatggatgaagacgaggcttttgtacaagtgccatcattgtttcccttgcactggtaggtccaataaaatccagggaaatccgtttgtgagtggccttgattgtcataattgttacaacctgtcgataaatcgaaggtggttgtcccccattgccaagtttgccagtactgagcagcatcaccttgtagatattcgaactggatttggaaatttggcatccaaactgtgcaaccgtcagaagaagggtaagcataaacctgaaaagtggatgtaaaatctgttggatcactgattaggtatgtcttctcatttttgccgtaaagttgtacggtgcttgagggaccgttgacaccaataatctttaaagaccataaatatttcaaagggatatcttttacggctttgacatgaatagtaatctggtatgtgttatccttgacccatgatacggaagtaacatccatatcataatgtagtatattctgttggctcatgtgccagttgaaatccaaatttggacaaccattgatagcaacgctttcgtctcttttgcttagatcaaatgaagggctcaccttgtcatcaattctatcagcagtcgctgaatttgtgagcaaggccgcaaataggaggcaaaatgatattagtagttttcttatgaatgatgtggatacctattttacacttttgcaacaaggggaggaaaattgccaagaccatcatgacattggaggaagtgatttgcttctcttaaatataaaataattaaacgatcatggagatgcagcgaactaatgtgaaaaatttttctttccagtagtatcggttattctgtaagcatagaatcgggtattagtggcttgttccgagctttttttctttgccaataagaaaacaagtaaaatgcaacgtgcaaatgctgatctgatctcgcctgggccagttttatcgtcatgtgcgcgtgtaggcacgaaaaaaaagaaaagaccgctacctctccttctaaaatgacaggaggagaatataaggtttggcagccccttgaaagagccgcaggaaccaaaaaaaaaagaaggaaagtttatttttttctttttccaaaagactttttaagatgtttgtcagcaagataatacaggacctacacgactatcagtcacagccagagaaacgtttgtcgtatgatggcaaaatatttttcccacaactttgaaattattttcaaatatggcagaacagtttaacatttggtttcaagaggtagcacaagttcttgaatagtatttgttcgcgttaagatggaagcaggccaaatgccccaataatctaataaccgtattttctatgctaaaggaggaacgaacactcggtcttgtacaggcagctctaaaaggaaaatttccatccccccaggccaagaaaatcagaatcatatggcccccttccattctaacggaatagtatatcaaagaaataatgtttacgtaagccatagacaagcgatataatcttttttatccttaaactaggtgcttcattaagaaagaagaagaaaagaagaaagtacgacaaagactccccgctggacaataaacgggggcggcaggtgttaattccgaattgaaatttaaatttgacataagcaaagtttaaagttttttttttccagttcttttttcccatcgtttttttttctagaagccgggtttttcaccgtcaaaaaatttcctaaaaaagatctgtcaatcattaagttttgctttttcggcttttaagccatgctttcaggcaaaaattaagatttcttcgtaaagatcggagccttacgcccaagaagcaactggccgtaaaattttttcttcgatcgggtggcaaatggaacagaagatcatgagtagaaggaaaagtaaacaaagaattgcgtcggtcaaccggttgttgctgcgtgcttcagcgggtgataaataaaagatttcctatctgagtaatcgatgacacaagcggtctgcgctcggtcgcttccaagccttaacaaagtttttactttatggtttttaataaataaataaaaagaaacgtggatttggatagcagaaagcctcgaagatcattttatcaatgaaattttatggttaacactttcaagactccgattttctctgctacgtgaaattttaggttgcgaaaagaatactaccgggaatactaggagtgtggaagaaaagaaatggaaaagaaaaggagaagtggtcattcttcacatctcattgtcttcctcctgtaaagattttagcttttttataaattaagattaagattgtagcgtgatgttctgttactgtcatttttgattggccaatgactgattataacagaagaccagttttctatgtattattgtccgacaagtcaggaacctctatcttctcagagcccattctggatactctgttttgtagcaccactttttcttttcggttccttcttcagtctcagttgattcgtatagataggcatgtaaccacagatcaagatcattggggccaggatcagtatacaaatcagattcacaaatagaacatttttcttgccttaatacctcaccgtacccgccattactatggaaccaacttttagcaggttttcttttccctatttcgtctagcttagtaataactatatcgaagtcagcctggccgccttttccgagattgttaccccatacttcatcattggaataaataggatcgttagcaattgggtggcctaagtactgtaaatgtactctaatttgatgtgatcgcccggtaagcggtttgcactttacaatactcgttttaccgtcgtagctgattctgttaaaaacagtttttgcatgtttggctcctttctcgtccatttgacaaactgcattaagagcaagccttggctcgatcagttttagaggtttttcaacaattacttccgtttctggaaattctccaactaccttggccacgtattccttagtgacttctcgagcttttagttgatcgccgatattatcggctcccttcggagtttttgccaaaaacattaatccacttgtaagcctatctaacctattacatgggttcacaacaaatccgagattattttgaagcattttcgtaattgtattgaaccgatatcggccagttgggtgaacaggtataccgctcggtttatcaataaccattatgttatcatcttcaaaaataactttgataggcctggaagtgactggaggttcatgtctatgtacctgatgcgtaatcaggtcaccattgcgaattacagtagataagtccgcagtttcatcgtttatatgaacgtccccgttttcgattgttcttttataatattcagattcacgatctcgaaattcagatataaagacatcaaccaattttttatctctccaacgctctttgcaaaaggtcctgtacgtaaaatggtagggcttgattttccttagagggccatcgatgacaatttcatactctggatctagttgtctatgtttctcttttttgctgcctatcgttcgtgattgaaaagtagatttattaatcaaatctggcgatttttttgattgagttcgctttattttttttttcttttgaatttccctctctctttcaacctcattttgcaaatgttcatcaaactcatttgaggttgcattacctgcaaaagcaagacctgcagataatgcattccttttgagttgtcgagccattattactggcactgtaaacaaatttcttaacctattatttctttgcataagtttcctattccattatacgagcactcatccattttcaaaagttttttatgaactttttcttaactcggtcttttgttctctaatggttcgccgccagacagaaaaaaagcttacttatcgaggaatcacattgcttcaatgaataaattctataatgcatatactacctaacatatataagagaagtgagcgtcattcatgtcggctacttgtcaatttgtattacgttccttactttccattttcaaacatcgcgatacaaaaactttataatggtccatttcttaagaaggctatcaaatctatgccgctactatcactactatcattatcgttctgcgcctcaattattggatcaggagtcgtacctggtattgtgggcttgaccagataattttcagatgcactagcatctgaatagcgtaaattcttatcctcttcaatgctattctcatcatcgtttgtgacaatattgcttgaaaagaagctggatttgaccatactgttagttgagacgtcctgatgtttatcgtgacttttattttggtttaatgcaaatttcaacccgggtagagaaaaatggtcgttattgtaccgtattttcaacaatctgtttaactcatcaagatctattccgccaagcattggaatatgatgaatgatcctccaaaacaagggcacttcaacctcttcggccgtgatgttattaagcattgcctgtagttcaagtgaatttgatggaagggagcgatcgctactattcgttttagtctcatcagattctgtgcgtttattatcgtttgaatctttggctgaatagtagttttcccagtattcaaaatcgtcacaattgtcataaaaactaaagtgtagttttagttcaaacaattgtttaaagaagcgttcaacaaaccacagtatacgcttcagagggtttgtagaatatttccagcattttcttttcttccacttaccacgataataccaacctcttttcccccaattgctgtgacaaaacttcagaatttccttttcaccaagctctcctttcagaatatatttttcaatgagatattttgattctgtttttgcccatgaatagttccaaggtttttccttgaacaggtaaacaatgacgtcgacgagacaacttaatggtcgaacgcaagtgtcaatgtatgtcacccacatggtaggcccatgctttatttcatgattgtattgcaacgcatctgcaatgatggggaaaagccatatcccaatatacgacagtggataaatgaatattgcccttagattcttttgaatttgtgccctacgttttttcatttgtttgtaggtttgggcttggaaatgctgttgtacgttggtgaaacttgaattttcgcatctgtctgcattattattcactctctcctgtgaaaattgttgagacggagtaaatgcttcattagaaagtgtaggaatattatcggctggattagtattattgttatcaacgttatttttaatattattactattattattattattgttgttgttgttgttattgttattattattgttattattattattgttattattattattgttattattattattgctattattgttatcgttatcgttatcgttattgttgttgttgtcgtcgtcgtcgttgttactgttgttgttgatgatgcctcctttttccttaatgttactagttatgtcgctgttatcgttcttattatcatacattgctaaaggagattctagagaattttggcaagagaaagtctgatgtcccagcattgaactttttcttgtatccagtccttcattttcaacactaaaagtaactttatgctccttttgcttggatactagttccgaaggattgagtgtgatgtcattttcacaatcaaaaggattatttctttccaaatctggctgttcagacattgcatatttggacatatcgagtggtttagcactgttatagtcaagtaagcgaactccaccacttgccgagacattctcatcactacctgtatttgtttttctgaatagtgtaggtatctcattcgaactctcaccaaaattgaaagttccattactactacctgaatcgtctgtttcctcattcggatctatgaacgaaatggtgaaaaaattctttaaatttctcaaaagatgtagcaatggcaatttaaaataggatctgaaataccatttggcttttccccagtgaccgagcccaaataattttttcttttctttctcttcctctagtacgttatggttaaagtctccaatttgcgctttaattcttttactttcactggtaatgaaaatataaatactgaggtagactgcaaatatgaaaataataatgaaatatctgggaccccagcttaaaacaattttataccagtacggcttgggtggtaaatagcaccatgcactccaaggtttgtagccaccttgcctgggagaatcgggaaagttgtagttattattatccagtataatagtggtgtcagaatcgtcattgagtttattataattaatgaaggctaagcttgctaaaatggcaggtactaatgcagtaattggccagatatatgacctttttttgtacaagccaccctccatatttcccgatcttttatttcgccatttccaattaggcttgaagatcaaaatagcaaaatgtatggcgaatatcattatggccatgtctgcaccttcgatggcaaaggccgtaaaccaacccaaggtattaaaaaatgcaggtgttgcatacacactattattaataaggataatcatgggataaatcatcagaataaaagctttaagaaagtcgcaaattatcaaaaatgcgatgagatcatgtctgaagacttttcgtctcttatccattttagaaaggaagaacattccgaggcaaccggcaataagggacacggcagacgcagttatagctattattcttaactgcaacagttgcggagccgtgaatgtagaggtcatccccggcaaccccagcagctggttaaccgtggtagtgttaagctgtcggagagaatcaactctcttttctagtaaggatgaccctttcaacgcgtttaaattcgggggaaatccctcagttatcattttgagttggagagtttgctttattcgtcacacttcggatcacttgtttgtcgttttttttttttggtgactcttactgctttttatagacacacacacacacacacacacacaccttcttctggataccgtagagaaagggatgtagacaaataaaaaaggacaaaagctagaaaaaagacggaagaggacgtgcgattgcgttgaatatgaccttcgcaaataaatattaataaatatgacgtttttgccgcaatgctaattctataacccactccttcgttgccttctatgctttaattaaacaatgggtccggctcaaacctggaaggaagatttataaatcttgaaaagaaaaaaaagtgtgatttaaaaaaatgaaaaagaaaaacaagagggcaaaaaaaaatgaactacttattgagacatgattcaagggaaaagaccttcatatatacagattacttttcgaaatggtcagccgcttcatgagctcttcttggctgtatcgtaccaccgtggttcaattaggcaagtatgttgctaagattaattgctgcagcgcatcgtataaggtgatatactaaattcattatcatcactatgcatgggtgtcattattattaacatgggaaatgggcccactcccaaggactctatcgtcgatatatagacagcacgattgcccaggagttatggcacgttgttttgaggctaagtgtattgttatgtcgaggttgtcggcagagcgattcagtttgcacgatttaatttggactgggacctgcagggaccggaattgtaatgtcaaggcaccagtattttggaaagcgtttatagtgtcctccctggggcccaaagacgaaaagttttcgattcgcatagtgtcactgtatagcgccggattatctcttcctctgactatcaagatttcgttggtatcccttagtttttcactgacaaaccaggtcccttggtaattagggtcagcttgtggcatggatatgcccactttctgtccaattgtgtaagaccacaatccatcgtgtctgccccatgtcgttttggcaccggattgtgggtcaacggtaatgatatcacccggtgaactgggtaggtagtgctttaaaaaattcttgaacttcccatgctgggaattgttgacgaagcatatgccctgtgaatcaggcttttctgcagtcgggaggcctgcatacttcgctaaatctcgtacttctggtttcgttagatggccaatgggtagcaacaaagatgacaaaacagtggagttgatttgtgaaaggtaatagctttgatccttgggcctataaatgcttctcagtaaatggaataatccttttccattcatttcctgcataactcgggcgtaatgaccagtaacaagccaatagttacccgtcccatacttctcatccagccactctctcagcttgccgaacttgacgaacttgttgcaaccgatatctggattgggtgtcgacccttcactgtagcctctcaacattggttcaaatacatctatccaataatcttgctcaaaattaactttgtcaactcggatgttcaaatgcttagcgacacggttcacatctctccaatccctctcgtagcatggctccttgccagggtcgtccaaagattgtgattcagaccagttctgcatatatactcctcgggtatttggaaattctccggcaaatagtgctgccgccacagaggaatctaccccagatgacattgccactatcacgttgtcaaactttgccggtagccgctgtggtctgtacggtgaagcactcctccgtcctattaaatttaaatatcttgccagcattgttatctgacttgaatcgattgccaaatcaatacgctcacatttttaacgttcttgtatgtttccaaactttcattcttttacaataaagcaatgttttgcctcaactattgaaagaaaaaaataagagaccaattgttactacccggcgctcttaaaattttcaagcgatgagatgaaattcatacaaaatggctttacagagagttactagtacttcactaacttcctactgcttgaagtaaagtcactaaaagtacttttgtcatttaagttaccaccacatatctctttaacctagaatatggcaggcgtgcagaaaagaaaaagggatctcgaagatcaagacgacaatggaagcgaggaggacgacatcgcctttgatattgcaaatgaaattgccttaaatgatagtgagagtgatgctaacgactccgatagtgaagttgaagctgattatggtcccaacgatgtccaggatgtgatcgagtacagctcagatgaagaagaaggagtgaacaataagaagaaggctgaaaacaaggacatcaagaaaaaaaagaatagtaagaaggaaatagcagcatttccaatgttagaaatgtcagatgatgaaaacaatgcatctggtaaaactcaaaccggtgatgatgaggatgatgtcaatgaatatttctccacaaataacttggagaaaacaaagcataaaaaaggtagttttcccagctttggcctatccaaaattgtattgaacaatattaaaaggaagggatttcgccaacccactcctattcaaaggaagactatcccattaattttgcaaagtagggatattgttggtatggcacgtaccggttctggtaagactgcagcattcatcttgccaatggtggaaaaattgaaaagtcactcaggtaaaattggcgcccgtgcagtcatcttatcgccttccagagaattagccatgcagactttcaacgttttcaaggattttgccagaggaacagaactaagaagcgtcctcttgactggtggtgattccttggaagaacaatttggcatgatgatgaccaacccagacgttattattgcaacacctggtagatttttacatctgaaagttgaaatgaacctcgatttgaagagtgttgagtacgttgttttcgatgaagctgataggttgttcgaaatgggttttcaagaacagttgaatgaattacttgcatctttgcctacaacaagacagactttgttgttttctgctactctacctaattcattggttgattttgttaaggctggtttggttaatccagttttggttcgtttggacgcggaaacgaaagtttcagagaacttagaaatgctttttctatccagtaaaaacgcagatagagaggcgaacctattatatattttgcaagaaatcataaagattccgttagccactagtgaacaacttcaaaagctgcaaaatagtaacaatgaggcagatagtgactcagatgatgaaaatgatcgccaaaagaagaggaggaatttcaagaaggaaaagttccgtaaacaaaaaatgcctgcagctaatgaacttccttctgaaaaagcaactattctgttcgttccaacaagacatcatgtggaatacatttctcaactcttaagagactgcggatacttgatttcgtacatctacggtactttggaccaacatgctcgtaaacgtcaattatataattttagggcgggcttaacttccattttggttgttacagatgttgctgcaagaggtgtcgatattccaatgttagccaatgttattaattacacattacctggttcatcaaaaatttttgtacatcgtgtaggtagaactgcaagagccggtaacaaaggttgggcatattccattgtcgctgaaaatgaattaccttacctattagatttggagctatttttggggaaaaaaattcttctaacaccaatgtacgatagtctagtcgacgtgatgaagaaaaggtggatagatgaaggaaaaccggaatatcaatttcaacccccaaagctttcttacacaaaaagactcgttctaggttcatgtccaagactggatgttgaaggcttaggtgatctttataagaatctgatgtcctctaattttgaccttcagttggcgaagaaaacagccatgaaggcagaaaaactttactacagaacacgcacttccgcctcccctgaatctttaaagagaagtaaagagatcatttcttctggctgggatgctcaaaatgcattttttggtaaaaatgaagagaaggaaaaattggattttttggctaaattgcaaaacagaagaaacaaggaaacggtatttgagttcaccagaaacccagacgatgaaatggcagtgtttatgaaaaggagaagaaagcaattagcgccaattcaacgaaaggcgactgaaagaagggaactattagaaaaggaaagaatggctggtcttcacattctatcgaagatgaaattttggaaaggtgacgatgttgagacaggttacaccgtgtcagaggatgccttaaaagaatttgaagatgcgcaccaattattagaagcacaggaaaacgaaaacaaaaagaaaaagaaaccgaagtcttttaaggatccaactttctttttaagtcactatgcgccagctggtgacatacaagataaacaattacagataaccaatgggttcgctaatgatgctgctcaagcggcttacgatttaaatagcgatgataaagtgcaagttcataagcaaacagcgaccgtaaaatgggataaaaaaagaaaaaaatatgttaatactcaaggtattgataacaagaaatatattattggtgaaagtggccaaaaaatcgcggcaagcttcaggtctggtagatttgatgattggtcgaaggcaagaaatttgaaaccattgaaggtaggttcgagagaaacaagcataccatctaacttgctcgaagacccttcacaaggtcctgctgcaaatggtagaaccgtccgtgggaaattcaagcataaacaaatgaaagcgcctaaaatgccagataaacacagagacaattattattcgcaaaagaagaaggtggaaaaggctctacaaagtggaatttccgtcaagggatataataacgctccgggtctgcgaagcgaattgaagtccactgagcaaattagaaaggacaggattatagcagagaaaaaacgtgcgaagaatgctcgtccttccaaaaagcgtaaattttagatagtttaaaaccatctagatctacagatatatagtttacatatgtaccatagcaagaaaacaaaaatagatagcgagtccgttcttcataattctttgtagttctttgtgatttcagtattttgtcgatgtaagtcatgttcaatattttttttgtagcgcattttattctaactttccgatgaggcaacaaagaagtgttaagtatcggctgacgaagtgcaataaaaagtacttagttatacggtagatcaagaaccttcggtgagccaagcgagggtgtatacattcatttaattttgctttaataggagtaggagggcatcatctcaatgaatttacttgaaacaaggaggtccttgttggaggagatggagattattgaaaatgccatagcagaaagaattcagcggaatccagagttatattaccactatatacaagaatcgagcaaggtgtttcctgatactaaactgcctagatcatcgttgattgcagagaataaaatatacaagtttaaaaaggttaagaggaagagaaaacagataattttgcagcaacatgagataaatatttttcttcgagactaccaagagaaacaacaaacttttaataaaatcaatcgtccagaagagacacaggaggatgacaaggatttgcctaatttcgaaagaaaactacaacagctagagaaggaactgaaaaatgaagatgagaactttgaattggatatcaactctaaaaaagacaaatacgctttattctcatcttcttctgatccatcgaggcgcacaaatatattgtctgacagagctcgagacctagacttaaatgaaatatttactagagatgagcaatatggtgaatatatggagctggaacaatttcattctttatggttgaatgtaattaaacggggcgattgttcactgcttcaatttctcgacatcctagaattatttttggacgacgagaaatatttgctaaccccaccgatggatcgcaagaatgatagatacatggcctttttgctaaagttgagcaaatatgtagaaacttttttcttcaaaagttatgctttgcttgacgctgcggcagttgaaaatctaatcaaatctgacttcgaacattcatactgtaggggatctcttcggtccgaggcaaaaggtatctattgccctttttgttcgaggtggttcaagacatcttccgttttcgaaagccatttagtagggaaaattcataagaaaaatgaatctaaaagaagaaattttgtgtactctgaatataaactgcatcggtatttgaaatatttaaatgatgaattttctcgaacgagaagttttgttgaaagaaaactggcatttactgcaaatgaaagaatggcagaaatggatatcttaacacagaagtatgaagcacctgcatatgattcgacggaaaaagagggggccgaacaagtggatggtgagcagagagatggtcaactgcaagaagagcacctctctggtaaatcgtttgacatgccattgggtccggatggattgcctatgccatactggctatacaaactgcatgggcttgacagagagtatcgctgcgaaatttgttcgaataaagtttataatgggcgacgcacttttgaaagacatttcaacgaagaaagacatatttatcacttgcgatgccttggtatcgaaccttcttcagtattcaagggcataaccaaaattaaggaggcacaagagctctggaaaaatatgcaggggcagtcacagttgacatctattgcagcagttcccccaaagcctaatccttcacaactaaaagttcctacagaattagaactagaagaagaagacgaagaaggaaatgtaatgagtaagaaggtctacgatgaacttaagaagcaaggtttggtgtgaaatctctctgtgatatgtatatttgtttgatagatagcagttgtatgtatttatactattcttagtaatgaccttattacccgtcttgtagaattgaaaggcgaaaaacaatttgaggacccatataatggaagaaaacggacgtgaaagttaaatatacgtaccagaagacaaatcacagtaataaactaacaaaactatataataataatggacccacataatccaattggtatgttgttgatatttttagtgtttgtggaggcaattgagctcggtgccccttttggctttgcctcttttgcattttagttcttttacccctatattattaatactaaccatctcgatatagtccttgatcagggtactggtttcgtcaaaattggtcgtgctggcgagaatttcccagattacacgtttccttctattgttggtagacccatcttgagggcggaagaacgtgccagcgttgctacaccattaaaggacattatgattggtgatgaggcaagtgaagttcgctcttatctgcaaatatcttatcctatggaaaacggtattattaagaattggacagatatggaacttctttgggattacgcctttttcgagcaaatgaaactaccatccacctccaacggtaagattttactaacggaacctccaatgaatccgctgaaaaatagggaaaaaatgtgtgaggtaatgttcgaaaaatacgattttggcggagtttatgttgccatccaagctgttctagcattgtacgcacaaggtttgtcttcaggagtcgtcgtcgattccggtgacggtgttactcatatagtcccagtttacgaatctgtcgttttgagccacttaacaagaagattagatgttgcgggtagagacgttactaggcatttgattgatctgctttctcgtcgtggttatgcatttaacagaactgcagatttcgaaactgtgcgtcagataaaggaaaaattatgttatgtttcatatgatttagacctagatacaaaattggctagagaaacaaccgcccttgtggaatcgtatgagttaccagatggcaggacaatcaaagtgggacaagagagatttgaagcaccagaatgtttgttccaacctggtttggttgacgttgaacaacctggcgtgggcgagctgttatttaatactgtgcaatcggctgatgttgatatcagaagttccctgtataaggccattgttctttcaggtggttcaagtatgtacccagggctgccttcgagattagagaaagaattgaaacaattatggtttagtagagttttacacaatgacccttcaagacttgataaattcaaagttagaattgaagatcctccaaggagaaagcatatggttttcattggtggtgccgttttagctagtatcatggctgataaagaccacatgtggttgtctaagcaagaatggcaagaaagcgggccatctgcaatgactaaatttggtccaagatagatttgaactttattgatccaaaagaattaataaaaaagtttaaatctacgaatgaaaaatggaaatggaataatataaacttatatataaatgtaataagttaataaggcacaattgttgaacaagcaatcaaaatataatatttcactgagcgccgttagaggatagttatccttttcttggtatttcaagtattcagtgtctgtgtcgaaaaattgattgatgatttatttaaatgaatatatataaatatgtaaaaaagagttgatcaaagtaaataaatcagtacatgcatggcaaactctaaatgtatttatgttcataactggcacatgcttttcttccttatgcggctcttctaaattttgtaatctgcaaatttccttaaaacagtgtctaccacatcattgagatcatcttgtgatatatgaggcttctcagagccatatctaacggcattcctaataaggtcttccataatcgatccggatatcataaaaggttgaaggaaagtgctactcaggactttatccacagtccatcttttgtctgggttcctgtacagacatgctttcattaattcaatggcagactttggaatcttttcattattgctagtatgttcaggaaatgggattttcacatcaggattcataatagccaacagcctattttggccttggaaactgccatatgggggtttcccgtaaatcatctgatatataatacaaccgcatgaccacatatcagatggtctccccactttccacttgtttccctcatgttggttctcactattttgtgtgtaattcatagcaactagtgcttctggtgccatataatttggagtcccaatttgagtttcacgatatatattcaccgtatgttccggtaccgcgtttgctataccaaaatcaatgatttttaagatacctttcactaaaacaaaatttgcaggttttaaatccgaatgaactatgcccgcatcatgaactactttaatgcacagcaacatttcctttgtatagaatctaacaaaattaaaatccagtggcatgccgcttctttggttaaggatttgtgacaaatcatgatcaccacattccattatcaaatacaataaaccatcccccatttcataatctagtagttggattacacgcttttggtctttcaatttttccagaagttctatttctcctttgaatccatcaatacttgaatcgtcaaaagcgtcaaaagacacccttttgagcgcgtataccctattgccagatcctttcaccttgtaaactctggaggatccacctctacccaaaagttctattttttcgtactgggagtcatttactgtaattatatttctattattcgataaagaagcggactttgcaggttcaacaatttcaactttcttggtgactggaggtttgggagcaggtcgatggtaaaatacttctagatttttactgtttatattctcattcgttattgcatcatccaatgatcgttttagtctcttattctcttgttgaaggagattatcagcgtgatttgcatttatgcttatgtttcgcagtacttctcttttttcggagtcggaatctttatttctggaaattcctttataaattttatgaattgggctgttgaaattgctgttattgctagtatcaatattctccttgagagctcttcttatttcgatcgatgacttagatgaagatgatccagtagaaacttttcgcctgggttgagaaccattattggatgttatagaattgtccttgtttgccaataagttgttactagaaagtgaagaggaagaagacctacttttataaagcaattctctggaactatgttttcggagtgctgcttgtctattttcttctctttgtttatcaaagtagatttgagatattagtggaaggtcacttgtgggaagattatgttttttaatatactggataggattcaaatctccaaaatcaattgaatcataatccgtattctctcttcgttctttaaagtttgtttggtgagaatcctcaagtggtaattccactgtctcccttgcatttattggctggtttggagagttaggcacatcctcatcaaagatatttgtcaaagtcatcgctctctttgcaggacccagcttcgttgtcctattggatattaaaaatctcttacttctcctttcagcatactttgccgtaatatcttctttcatattttgtcgcaaattccttatcctttcaaaactcttatcaagactatttccaacatttatctctatgtcactagtgttcatcgtcgtcatgctagtctggtgattatttctcagatatcgtccgaacaaggttgaatgcgatgaggtactagtatgaccggatgtcaaattgcccattgacggtggggggtgactccttgatgaactcctgtccatttcttctaatcgatttgcgatcttgtcattattatgacttgataatatctctgatgctgaagttttttctgtgtgggaaagtaaagctgatccgaaattgcttagttttggaggcgtagtgaactcttcgtcatctgaaaactgtcgtgtattagttctcgattttaaatccacataatcatggaatgagtttgttgacatgtttgttttgagatcatccagttcttgcagaaacaatttattattttggttgtaaagctacttctataaacaactgcaatattcctattcagacttcagtgggctgggtcaagtaggcttctataaattttgtaggttactattaatatagtagatcttaaattctctttaagcttgccttcacataaacatcactattactctttgcaacccttggtagtttttttttggttttgtttactatttctaattgatattatcatttaatacgatggaagtgacaccaaaaattattttgtgtcactgcacaccataaataaaggtattggtcagaatatataaacatgtatgatatataaattgtggcatcacagtaatgctcaaacaaaaactttaatgttctttactcttttagggtgtattcagtgtttttgtcgtttatttttgaaatgttatattttgaaaagaattctccagaatcaccatttgttgtgataacaaagtgttttgatagtagcgtatttacacttttgatggcaataattgtgttaagggttttgctgctgttagaggtttcactttcttgtaatatcttgaaaaaatcagccttcgaataagctccgccattgaacattattgcaggaaaggattcgtctaaaataatgacatatacgtctgcaatatgcttcttgccctcgagtttttttgaagggtttagcggtaaatttttcattgagtctaaatacaacttgtatcgaacactggaaaatatgaaagtttggaattttctgagttcacttcggcaattatcaatatcgagttccaagtcataggattctttgatccatttctcgacgctgtctcctaaaaagtaggatcttattcccagttcgttcttggtgaaggactccaacactcttttctgcaggaaacttagaaactgctttctggtttcttcttgctttactaaatcaacattcaaacctttggcaaactcgtttggaattcccatcctggaagatatctctttccaactctgaaccataggttgtaattgtaatgatctcatggtgggtaatgttattttcaattttgttttcggtaaggaggtcaagacatctttgtaaaagatatttttctgccattttttgaattgtttaaaaaaaaagaacataataagaaggggaaaaaaaaagtgaaaaattaagggaataacgactatcgttgatgttagaatgaatgtgaagatacttgcagttgcaaatatgataaaaaatggggagactttatatactttcacaaacggcttgttaccgttctttggtgacttcgaagaaaatataaactttatttctgcacgtcgtgacgaatggaaggctcttttaccaaccaacctggatgtcgagcttttcagactggatagaaattggtgagtggtagaacaataattagaagaaatgcatgaaagcttacgaaactggaaactttctcctcgatattttggaattgcgggagatgtaatcgccgaaggcactggtttaggaaaagcccttaatattcctggcaagtacatattgaaaccctttccattattgagactattgagcgtaacgctgttcataagctcccttgtcctactggctaatcccactggaactttgaacattttttcctactcatatgtggttatggtggtcttatttatctgcgctaaatcacttttcaattattctttgcagtttataggggaggagacttcctctttgtaaaatctaatagggcgtgttcacaattttatgcgtcgggtgacttcaatttggcgcccgttgagattatctaaaaaatgcttttatttatttaagcgctttttgttttgacgaatgtatttatgtttttgtatatatatgagcgttttttttttccagatttaactagttttctttttcacctgtatgcacaccatcttttattcctatataatgccttttatagtactttgaatcttctatatacaattttttaggttttatcttttaaaaagtgtttatttcattaatttgaatctttattcccgtgttgcttggtcagctcattcaactcctcctcagtgaccaagtgatgcttatgattctttggtttttcaaccaaatcgccagatgtagggtcaacttcacaggaggggacggatacaagccaatcatcctttaccacgtcattcattaaaactctttgctttggttctaaagccaacattctgcctattattgtccgtgaatgtcttggcagtagccttaatattttatttggcccccgaactatatcatcttcgtcctcaggttcctcagtaaataacctaaatgagttgaagctcttttttggagccttccaaggaaatcttttaaggaccatacagtaaaatataatagcgatagaccacacatctgctactcttggatcgtaggatgtttgtttcaataactcaggagccaaataagggtcagaacccacgattccatgtgattttacaatggtatcttcgtaagggtattggaacactacagcgctcccaaagtcaatcagtttcaagatgccatctttagtgacgacacaattgtccaattttaaatccctatgagctaagcccatagagtgcaggtaattaacgccgtggcacagctgcttgaagtaacagttgacttcatcttgtgtcattaggttactcatgacgagattaaaaaaatcatatggcgcatactccattactaataaataggtgtcaccttcagtcaacatatctagggtttcaacgatattttcgtggtgcagcgtggaaccaatacaaaattcagtggtaaccttcttagaataattagctaattgagactgattagttccttcattgtttaagtgtggttttctgaacattttgcaagcaaataacttgccgtctgttctttctactacggacactgaaccggaagctccttcgcctaattttctaccaggaataccatatttttctaatagctccactgggttatctgtttcgtataacgcttttccgttactttctactatattttcattggtgttcaaattgagcttcggttttgtaggggtggatccacggttgtgatggtggtgatgatgatggttatcgtgataatcattatgaatttttttgaaaaatcttgttaatctcaaggattttttctttcttgatgaggtatcatcactaccgcttgaagaattatgctgtagttccacggacccaggggtggaggcttgagagtccatgaagtgtttgtcttcaatctgtttctgtagtatctctacgggatgcatatgtgcctggtatgataaattcgaagagggtgtatcagattttgcagaagacactgtagaaatgttgctatgagctgtagagcgaacggggtgaggatggtggaaagcatcttttgagccttgatgaatgtagtttattggattgtgaatactatggggtaagtggggcacagtgtgtcccgtacgaacgggattatgattgttaggtaagggccgtgaaggagagtagtcaataggagcttttttagctgaagtaggagaaatacctgtcaaagtagaacttgctactacgtgtgactcctttgacaacgcgccatttccctgggggctctttcctatggtagatcttcggtcgttgggtttgttatactttatttgatcctcttggtcagaatctgtattcttttttgaagatctagaagaagaccttgaaacatcatctgtctttgagtatgattggttaccacctccattgaatattttagccgataaattcttcaacttagttggcctaaataatgaagacagcgaagttgatgaagatgagtgtaatggagtttccttaaccattatgctatgaatttcaggctgctcttttctgtccttctctctttttttccctctcaaatcctctcagcttattagcgcactaaagagtcagtttgggtgaatagcgtaatcaacttatggaaaagaagaacactagaatccgtcactattggctgcaaataagtattatatcttttttcaatgagaaatcttgcttgccccataacaggtacaatacttagcaagccaggaagagtcacactgcaaaatagatatatgagaagcggaagtagcttttccccttatagatgtacgccgttcgatattacccgaactgcaagaaaagcttctccaaatatctactggcctccattcaagaaggcaattaaagagactatgtgtacatgaatgggaacttggtatgatggtagtaatgctttattagtcattcccctacccccttgcgcaacctatcattttacttgccagatgtgctctccactgttagagcctcttcgctgacaaagaatggacgagtacgcgagcggtgaaacgagcactgcaggcaagagaaagaaaaatcatgcatgatttggaaagcgaataagaaatgacgcagttgagtgtttgagttggagccagctgtgttattcacaggttcatttcgagaaaataaacgcctttggtggaagcggacactatatttcacattttagctgtagaagtaaaaaatttatttcaagtttacttaatccattcaagcagtgctttcccggagtttcgaataaaagacactgaggacttttcagtttgaatttgagatatgttgtggaagtttcccaataccagaaccgcctttgaaatccggaagttttcttttatgttcttgtgaattttctatccgagttttaactttcgatattcagaaagaatagccgttcatctcttttatattatatttagcgatgtaatgaaagtaaaaaaacaaaaaaaaaaaacaacaataatcaaatgacgcatatctaaatattccagaaaagaatataaataacgagggtgataaagcgggtgcaattaaattctctgtagtacaaaaatatgtaataaccgcagaacttgttagtggaatctcttttagatgtagcttgaaggctcaattcgctccccttcggtttgctgaaggaagaacgatgcggaatattactttgtgaccatgttatgtaaagacaatttcctatttttttttatttctgcccatgcatggcttattgattcactaaggatgcgttataccttgttgtgttccaatcccagtaaaacgtcaattccttttctttgctaactttggagacgtcgcaatcttcatagaagctcacacctcgtaatctgtctttggcatactcgtaaaatgtgccctcttcacatgaaaaacctggaccactggagcaactctctataggaaccacagcatcgttgaccacataacggacgtacgaatcgtttgagcattgaaacttttctgtgtagactctagctccctgaggaatgtaccacgacctgtggtaggaatgatcacgaaagggaacatgattggttgttaaatttctagtgtcatcaatcaatccagcagttgtcaaataatttagaatatcagtatcgtgcgtaaagctcagccaaactttttggtccaagtgcgcactttgtcgtattagcttcactgttgcattgaacaaattagcacctatagatttaatcaatttgtatccgggaccattttggtagaagctcgtcaaatcagtctcataagaataatgtattaactctgccgcggagaaaatgtcacaaatgttactataaccttttgcgttcaactcgaaggcacaccaagaaaacaaggccgctgcatctttcctgctcaagttcagccctttattttcgtcattaagacgatcggaaatattttctaagtagtccctcgaatatgacattaatatatcattgttggcattcgaattccaattggggcacgaacttttggcagctaatgtgtttgctcctgacgaggaattttcgctaagtgtttgaagtgatatattaaagccatcgcccaaagcctcggcaaaatattgcgcagtatcgtagattcttttcgaatttgtggtgaagataggaaagttggtacagttctccatcaattttccatattttgctaaaaactcccttgcatgtctctttgcattcatttctcctgtatacgggttcaacacatcaatcgaattttgcaaagttgtctccatttctagaagactttcatcgggaataaaaaattcatatccattattcaaaaacgataatgatccctcgtacttacctgtgtaattggatattttataccatacttcaaaaatatccttggcctcacttctggtaggatacctttcgccatgtctgccaatcatttgaacttgcgttaatctacaaccttcaggaatatcagtgggtataccgtagttagcgggaaaggagaaatatggcgcagaccctccaagaaagggaaacagactcttctgagagccaattagttcaatatccgcaaaacttctgagtgggatggagagtgccttagataatagaacacctaaacaaatggcaaaaataacgggcttcaccattgttcctgtatggtgtattagaacatagctgaaaatacttctgcctcaaaaaagtgttaaaaaaaagaggcattatatagaggtaaagcctacaggcgcaagataacacatcaccgctctcccccctctcatgaaaagtcatcgctaaagaggaacactgaaggttcccgtaggttgtctttggcacaaggtagtacatggtaaaaactcaggatggaataattcaaattcaccaatttcaacgtcccttgtttaaaaagaaaagaatttttctctttaaggtagcactaatgcattatcgatgatgtaaccattcacacaggttatttagcttttgatccttgaaccattaattaacccagaaatagaaattacccaagtggggctctccaacacaatgagaggaaaggtgactttttaagggggccagaccctgttaaaaacctttgatggctatgtaataatagtaaattaagtgcaaacatgtaagaaagattctcggtaacgaccatacaaatattgggcgtgtggcgtagtcggtagcgcgctcccttagcatgggagaggtctccggttcgattccggactcgtccaaattattttttactttccgcggtgccgagatgcagacgtggccaactgtgtctgccgtcgcaaaatgatttgaattttgcgtcgcgcacgtttctcacgtacataataagtattttcatacagttctagcaagacgaggtggtcaaaatagaagcgtcctatgttttacagtacaagacagtccatactgaaatgacaacgtacttgacttttcagtattttctttttctcacagtctggttatttttgaaagcgcacgaaatatatgtaggcaagcattttctgagtctgctgacctctaaaattaatgctattgtgcaccttagtaacccaaggcaggacagttaccttgcgtggtgttactatggccggaagcccgaaagagttatcgttactccgattattttgtacagctgatgggaccttgccgtcttcattttttttttttttcacctatagagccgggcagagctgcccggcttaactaagggccggaaaaaaaacggaaaaaagaaagccaagcgtgtagacgtagtataacagtatatctgacacgcacgtgatgaccacgtaatcgcatcgcccctcacctctcacctctcaccgctgactcagcttcactaaaaaggaaaatatatactctttcccaggcaaggtgacagcggtccccgtctcctccacaaaggcctctcctggggtttgagcaagtctaagtttacgtagcataaaaattctcggattgcgtcaaataataaaaaaagtaaccccacttctacttctacatcggaaaaacattccattcacatatcgtctttggcctatcttgttttgtcctcggtagatcaggtcagtacaaacgcaacacgaaagaacaaaaaaagaagaaaacagaaggccaagacagggtcaatgagactgttgtcctcctactgtccctatgtctctggccgatcacgcgccattgtccctcagaaacaaatcaaacacccacaccccgggcacccaaagtccccacccacaccaccaatacgtaaacggggcgccccctgcaggccctcctgcgcgcggcctcccgccttgcttctctccccttccttttctttttccagttttccctattttgtccctttttccgcacaacaagtatcagaatgggttcatcaaatctatccaacctaattcgcacgtagactggcttggtattggcagtttcgtagttatatatatactaccatgagtgaaactgttacgttaccttaaattctttctccctttaattttcttttatcttactctcctacataagacatcaagaaacaattgtatattgtacaccccccccctccacaaacacaaatattgataatataaagatgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattagatttattggagaaagataacatatcatactttcccccacttttttcgaggctcttctatatcatattcataaattagcattatgtcatttctcataactactttatcacgttagaaattacttattattattaaattaatacaaaatttagtaaccaaataaatataaataaatatgtatatttaaattttaaaaaaaaaatcctatagagcaaaaggattttccattataatattagctgtacacctcttccgcattttttgagggtggttacaacaccactcattcagaggctgtcggcacagttgcttctagcatctggcgtccgtatgtatgggtgtattttaaataataaacaaagtgccacaccttcaccaattatgtctttaagaaatggacaagttccaaagagcttgcccaaggctcgacaaggatgtactttggaatatctatattcaagtacgtggcgcgcatatgtttgagtgtgcacacaataaaggtttttagatattttgcggcgtcctaagaaaataaggggtttcttaaaaaataacaatagcaaacaaagttccttacgatgatttcagatgtgaatagcatggtcatgatgagtatatacgtttttataaataattaaaagttttcctcttgtctgtttttttgttggctcgtggttgttctcgaaaaaggagagttttcattttcgaaataggtgattatcatcatgttgttatcaccccacgacgaagataatacggagctcaccgttttctttttttttccctttggctgaaatttcccaccagaacaaacgtgacaaaattatctttgaatccaaagtagcttatatatatacgtagaagtgtttcgagacacacatccaaatacgaggttgttcaatttaaacccaagaatacataaaaaaaatatagatatattaacttagtaaacaatgactgcaagcacaccatccaatgtcatgacattgttcttgttaaggcatggacaaagtgaattgaatcacgagaatatattctgtggttggattgacgctaagctaaccgaaaaaggtaaagaacaagctcgtcattctgccgagctaatcgaacaatattgtaaagctaataatttgagattaccccagattggttacacctcacgtttaattaggacccaacagaccatagaaacgatgtgtgaagaatttaagttaaagccacaactgcaggttgtttacgactttaataaaatcaaacttggagacgaatttggcagtgatgacaaggataatatgaaaatcccgattcttcaaacttggaggctaaatgaacgtcattacggttcctggcagggccagaggaaaccgaatgttttaaaagaatatggtaaggataaatatatgttcattaggagagattacgagggtaagccaccacctgtagatcttgaccgtgagatgattcaacaagaaaatgagaagggctcttctactgggtacgaattcaaggagccaaacagacaaataaaatatgaattggaatgcagcaatcatgacattgtattaccggattccgaatctcttcgtgaagtggtttatagattgaatccttttctacaaaatgtcatattaaaattagccaatcaatatgatgaatcttcatgcctgattgtgggccatggaagttcagtgagatcgctactgaaaattctggagggtatatcagatgatgacatcaagaatgttgatattccaaatggtatccccttagtcgttgaattagataagaataatggtcttaagtttatcagaaaattctacctagatcctgaatctgctaagatcaatgctgagaaagtccgtaatgagggtttcataaaaaatccttaaggggggtaagtatataatataattgtgtattttccgaagtataatgaaaaccaatagaaaacttattataagtccaatgaggtactttaaaaatgtgatatttataagaacattcctgaatgcagatatatgatatatattgtaaatatatatagatgtgtatatgtatttccattttgtgtgaggttttcttcttttatctcctatataatttgtaaccttaattaacccatgacataaccaatattagcctttgcaaattttgtaacttcttgacgttgttctaacgacaaatcttcatgcttcgattttatatgccttgttaaagcatccagtctcgaaaacgtcttctgatagccctcagatccaagaatttttatacactccgagcaacggaagacaatcttccttttagcgtgaatggtattttggtgtctcgttaaatcataggaccttgaaaattgggcaccacacggttcatttgtaatgagattcattatctgacacgtaaatatttcgttattaccgtcagaagatgacgtatgggccgatggtgatgcagtcgaaggtttcgaattcgaatttgtagatgaatgtgaagataagtgcttcttagtataattaattagcttccgcctactagcatttgagcttactacagctgatgtaggcttctttattctttctaatgtgccgttttcattactgttactaacgcaactacggttactggatgattttgctggtttccttttaccggtagtagcagtagacggtacgtttgccgaggttgagggagatggaaatctttcaaaatcaatagtgtttttattgaggacaaaactttgctttcttctgttcttcaagagagagatatcgtagatatcgtcttcatcaagatcattatcctcatcctcatcctctatcttctcatgtccccgttcatctaacagatcttcagatacaacactggaaatgctgtccatgttagagtcaacgtaactgtactcattaaataaatgactagaactcttggcacgacccgttttttgatctgagccaaacattgagattggtgtaacatccaatgacagtaaaggctcctcttggtgttgctcttgttgcaaacaattttcttctatttcatcctcttcatcatcactgatatcgtcgtcatcagagtcaaattcattgttaaaaatagctctcgcatcctcattgtttattgcggcgctattatcttgaagtgaccactgcattttcggattataattatcctcatagaaaagcacttcttcatcattaccatatagattgtcaccgttatcgaaaaaatcgttggaaattttaacatcataattgaacgtattccgtgtcggtacatacgggtctgatactttcattatattctttagattgacggtcttctgcaatggggtttcgctagcacccttaatctcgtttggtatgagatggacattattaatctgtctatcgttggccgttgcttcactagtcgtaaaagaggtggtggtagttaaagtaggatccgcgtatttgttgaatatcgggaaatggtaggtttgttgtgggggtatcgaagctgcactcgattcattctggtgttgtaatgaatgattccacgtaaaagtgttgttttccttgttcttattcaccaacttatatggagtaatactagcatttggatgatagttttgataatgactcgtaaactgactgtgacctggattagtatggtacaactcgtcttctaaaatatccgttaaggttctttttaggctaagttccgtagaagccatgattgcttgaaaattctagaaaacttttgaaaagatacaaattagctattagtactatctactattagttcaactaaaaagcggagttcttccttgaggagaaaaggatgaacaaaatggaactgatctactccttaaatattccacgccaagaagaaaaaagagtttcgggtttatctttaatttatattagagataaaacgtatcctcctccttgaacgataaaaaattatccgtgtgggttaggctgctcatcccgggctttccccaaattgggcttcgaactattctttccttatatagaattgctctcctcaacaagtttcgccgaaacggaactttctagaaccatcactgtaaacggctattagtaatagcgatcacgtgattatccgtggaaaggttcgtacgggctgaggcacctttctttgagttccacggaacttgttattacaggaacagaaaggtagtaaaaaaagaagtaacgtcctctcagtgcatatagtttgatctctataacaatccgtagttggttttctcaacaattaatattgaatacgttagtgatgattggttttcaacctctgccgctaatttaggcacagttctatcgcagccgtaatggaggcattatatagcactttagcgtcgtaacgaagggttatggtaaccgcctaacgattttatttactcgcttgttgcttgctttgtaattggttatatggatttcaaaataatatggtcatctgaccatggtgacataaccaaagtgttcgaaaagataactaaattgatacatctaggaaaactgaaggaaatccctattgttaagtaaacatactatatatgccaaaagaaacaaatgtgcggtagaataaaatacaattcagtacaataaaatacattcaaaatacatacaagtaccaggaaaaaagctcgcataaaaaaggcgtgttaaaaaatgtcaccacaatctttcaaatcatgatctcttcttttaacccaatatttgcccgtatatctccaatatttagcttttgtgatgggatgagtatccctgacgaaccattgtgggtgatattcaaggttattttcctccctttttctgcgtgctgctctttgcttttcttcaactctgaatttctcatcaccagcttcgtcataacgcccatcttccattgctctttgatctggtctcaaacgtgtatctgtggggggtaaccatggcaatagatgtggttgtggagcattcagcgtgatagcaaaaggtgttaaattgaatggctcctcaggacggtcgtttgccttccatattaaaaacttcgttccgtcatccgtaggcccattccctgctgatgcagcggttctagttttctccaacgagagatcgccatcttttactactttcttggcaaaaatagcttcattccagtgtcctcctaggatccacaccttctgttttttcttgttgtagacttcgcctgtgatttcatatgctcctgatgacctccatccccttgctttgaaatacaacttgcaatgatcaccggttgtgtgattgacaacgttcacttcaccgtggttatcaacttgtggattaccaatgagaatacctataacagtattgttgggcttcttccaagtatacagttcctctttttcattgtcatttggacgcaacttaatgtgccataatcctaagtgcttaacattgaaagatctgccattgaatttagtatcaacaaatgattcaccccaaaagtcccatcttggtgattcagtccatgttgcagatataggagggtgatgtgaaacctgctcggtgaaaaatctgtactgtttatctggtcgagaatactcaaatgtttcacccaacaatgggttgaagggtttcgcaactctttttgtagtagatgcgtatgaagatgcggtaaatgccgcaacatatagagttctcagtgttgaatcttcaaacgttgcagcctggtctaatagttcggaatactccaaatcctctgccactctttgtaaaagagatgtaggctcattgaaagtaactggtaacgtcattcttgtcatatctttgcccaccatcgatttcagaacggcccaaagactaatctttggtctatcgtccttatccatagatagtctttttctaataccatcttcataaccaagataggacccttctttgagtaaatattcttcttttcttttttgcactgtagtgacagcaactatggtcttttcaccgataactgaagatgctatctctttagttttctcctttacttggctctctttgtcctccgctttgaagtttttcagtgattgatcagtttttggttcatcttctgtaactagattattttgtttttcaaatttttggcttgttttctcaacatttgactctattttgcttttttcgtcctggacatactggctgtcgttatctgtttcatttggaactgggggaggagcatgcttgggagctgcagcggtcgaaatttcaggatgagcctctgttaattcagttacttcatccaccaattccgcggcatcataaaactcatcagcatcagatgcttcatcttcttcctttgtagcgctgataaatttcgcaatttgaccgagagtacttgccgtagtatctgattcctgttctttgtcattttctaaggattccttgttgccggcagtggcatgtgattccagcaatttcttgtgtagtatctttttcaaacctcttctttctttatcaatagatgctagacgttcggttttgttggacaactccatttctaattctttcacagattgcacccaaacgttattgacatcaccttgctttgaaaccatatccactaatcttttgtctcttttataagtcaagtccttcaacttaccaaaaatggttgatgtgttgatgaggctcttctttattgtgagccaaacctcaggacttggctcctcttgttcaattagttcaatcaaagaactcaactctatactgattgcttgttcatacatatcaagtttctccttatatggcccatactgtgctttgatgtattcttcatcacgatcaaaatttattccaaggtcttcctcttcatcatctgaatttgcctcatcaccctcgaaattatcaatatagttattatcactcaaggaagcagtagatcctgttgtggtgttagactggctcaaattcgcaccgttagggactttatctataggactagctacacctgagccactttgcatactccggttacttttcaaggtattactactgcggaccctttgcagagctgaacctgtgtgtactccaacgggggttttgctaccatccagccggttttcaatcattttactaacaaagcgcttgccagattcagtcaaattatcgtttagttggatttcgctggatacgacggacaggttgttgcttggtctccgataaagactcacagaggagggctgaataacttccttgtgtaatgtgtgctgatagtattgcgaagcttcaggaagagatccttgtgttttggaatgcgatatcagggctggagatttgttcttcaaggccaatgatggtggtactgccttttttttgtttaatatctccttgtctttggcgaatctaatagcgctttgtatagcattgacccacctagtcgtttcaatgggatgattgccctttaagcgccaccttgttgtgcctgtgatgccacctagcaactcgaaattcagtttttctgaagaatcgatgtgtaagcggcacgtcgaaacttttaaagtaccacgaggcctatcaacatgcgattggtctttgtaatatgacagatttccgtcgccacttaaaatgaaccaacgtaatttgtagccatgggcaaaatttgtccatttctttaaaaaccccttatacgtaggaggcttacttgatgcgacatcttcgtgaacaatagcttgttctctcagattcttttcaagtagattctttaacttaatttccggtgtaacgttgttcgacggtttagcgggtagttttatatttttgactaaatccaatggcgaccgtcccttcccatctttaactgttgcttctgcaccatgtttcagcagccattgacacatttcaatgtcttttttttgcgaatattcatacagaagtgtcgttccggtttcaggatctatgccattaatatctagtaaatttaggtttcttggatttttccaaatagagtccaatttcgaaaagtctcttttattcatggctgctctcaaagaatgaactgtttccaaaaaatagtcatctcttttcaattgaatcatttgtgctacattcaaatctttgcacatgtccaaaggctgctgatgagctttattcttgacacaatcattgatagacttctggctaagaaggaaactgatcacatccgaccgagattgagcagcagccaagtgcaatggagtattgccattttcatcctgataattcaaatctagatggataccatcatcgcttttactcgaactcttctcatcacctacttggtccacccaatgagcaacaatttccttgataagaagaataggggccacctggacagcataatgtaaaattaaattaagaacttgctgtacagatgggtcgtctttaggttgaaattcattgtccacaagcgcctttaaatgtttgaaatccccctgacccaaaacttccagcagcttcactttgagtaaaggtttgctcacttggttgagatcttcagcaatggacaagtcttccctagacatattgtgaagttttcagttggcgagcttaagcttatgattatcgatgaaatatgctaggttaaatttaaaaattttccttgggacgattggttgatattcacctttgtaatattaagcaactttggtaaatagattatatacgttgaaaaaagagaccagaatatcttgcacttaaaaccaaaaaagaagccaaaactacaaaaaattcgtgtcgcctttccttttccctgttgttttgcctcttctccctttgcgaagcgattcattttaaaagttagagtaatacgatttccacgtcgttcctccttctcgcgccaaagggggtagggaagagaagggaggagcccttgttataacggttccgcaggagcgaaaaagaccctgaggctttgccaaggatagaaagaataccccagagaaaaggtgagcagcaagtaagactcgtttcgtagttaaaaaaaactgtcaacatttcgagcttgatattaatattacaaatcattattcgtttgccaagaggaacacatcatttgtatttcttcttttgttgcattgcaattgggcatactatctataggtcttgcaatgtaattaaaaacaagtgcagagctgctgatattgctaatcggaaagagcaaagaaagcaggctcaagtctgaataaagccatgggatgagttatttctagagattcttggcatgcggtttaagtctttatgtagcacgttagtgaagcataatgacgattttcttttgttatttctggcttaacagttttacatttagatatcttataactattaaggctttgggatagcatgttcaatcttgcctgtaatgcggattgactctttgtaaacaattttacaagatacattaatagatgaatcggcaatttttctttttcaaagttgtgttatatccttgtattttctggcacacttgcttatcacttctttcactaaaaatatagtttaacactccaagaggaataccatccccaagcgagttgattgactgcaagtgtaattaaataggtggaaattgcatggtgcatatgccaatggctaagaaaaaattactcttacaaagattattttgtcaatttctcgaagaaaacaatgctacattttgaaataggattttttaaatcgtgacatgtgctttaatagaaacgtcacttcagctctgtcattacataagatttaacatgagcaaaagggctattttggatacggtatgtcattcctttcccctattaaatatgaagaacatatattctcaagttgatagaaaatgcaggaacaatacacaactatttacacattatgctttctcgattctctgaaaatgaactccagtatggcaatttgagcgcagctcattccgatgattaataatatgccgtaaatagaaaacattacaattctatgctctgttgaacaaacggtgtgatgatttctggtgtttctgcttttatagtactgtatattacgttccaaaacgtggagctgcctttctatggtgtctatagaattttccacactgtcttgcaagggatcggttttagagtctctcaggtttctctgcgcctttctcgccttgcgtctttcatttcgaatatcatcttggcgttcacaattgtacttgaagtccagatcaacaatcttgtcgtgtgctttaccaccataaaagcagatagcatattctcccttatgttggcctataaatgaccattcaccttgacgttcaccagatctctcgattattggcttgtttttgtcatcaggagcaaatatttcgtagttaacatcaaagtcattgctctctccttgctgtactgcaaaataatatgagattgtacagtcaatttccggagttagcgtatataagcactcctttcgacctttattcagttcaaatgtcaacggtgatgcctcagcaaaaaattgtgctaaaaaaaaaaactggaagaaaagtacacataaattggacatgacggagttttttagtcagttcacagtgtcccttcaagtacggtaactatcaagagccttaccagtttctgtcaagatattgtccccccaaattctttcattgaggagaggattatgaagaacgcgttctgttttaaagagagaaaaattcaggtcaggacgcgttggtctcacctttgttgacataatgaccatgacagtgtaggaagtctaagtagtatgtggaaacctacgcgatcatactgatacgttcgtaaactttatcaacgaacgacgctttttttttaaacctctatataagcatgtttttagcttgggaaattaaggtgtagccctggttttgaagataattaagaatctaatggggcaatgcttgtgtagatgacattttatagagtaaaattacttcccgtttagctcgataaacgccttaggcctacataaatcttaaacatttgtccccggtcagcttttaaattatgtcttctttgccctggggcgtcttcttgaacggcatcaatttagtgagtagaagagcacttcacatttccgcctaaaatcaatgcaagaaccattaacaaaaaaaaccgctcagcaggcgtaacgggaagtaacagactaccttaaattttcaataacaattgtgctattatctaattttcttaggaaagaggcagtttcgaagtagaacaatcataatgacaagcaaaacgaagaatatcgatgatatacctccagaaatcaaagaagagatgatacagctctatcatgatctaccgggtatagaaaatgaatataaactcatagacaagatcggtgagggaacattttcgtcagtgtataaagccaaagatatcactgggaaaataacaaaaaaatttgcatcacatttttggaattatggttcgaactatgttgctttgaagaaaatatacgttacctcgtcaccgcaaagaatttataatgagctcaacctgctgtacataatgacgggatcttcgagagtagcccctctatgtgatgcaaaaagggtgcgagatcaagtcattgctgttttaccgtactatccccacgaggagttccgaactttctacagggatctaccaatcaagggaatcaagaagtacatttgggagctactaagagcattgaagtttgttcattcgaagggaattattcatagagacatcaaaccgacaaattttttatttaatttggaattggggcgtggagtgcttgttgattttggtctagccgaggctcaaatggattataaaagcatgatatctagtcaaaacgattacgacaattatgcaaatacaaaccatgatggtggatattcaatgaggaatcacgaacaattttgtccatgcattatgcgtaatcaatattctcctaactcacataaccaaacacctcctatggtcaccatacaaaatggcaaggtcgtccacttaaacaatgtaaatggggtggatctgacaaagggttatcctaaaaatgaaacgcgtagaattaaaagggctaatagagcagggactcgtggatttcgggcaccagaagtgttaatgaagtgtggggctcaaagcacaaagattgatatatggtccgtaggtgttattcttttaagtcttttgggcagaagatttccaatgttccaaagtttagatgatgcggattctttgctagagttatgtactatttttggttggaaagaattaagaaaatgcgcagcgttgcatggattgggtttcgaagctagtgggctcatttgggataaaccaaacggatattctaatggattgaaggaatttgtttatgatttgcttaataaagaatgtaccataggtacgttccctgagtacagtgttgcttttgaaacattcggatttctacaacaagaattacatgacaggatgtccattgaacctcaattacctgaccccaagacaaatatggatgctgttgatgcctatgagttgaaaaagtatcaagaagaaatttggtccgatcattattggtgcttccaggttttggaacaatgcttcgaaatggatcctcaaaagcgtagttcagcagaagatttactgaaaaccccgtttttcaatgaattgaatgaaaacacatatttactggatggcgagagtactgacgaagatgacgttgtcagctcaagcgaggcagatttgctcgataaggatgttctcctaatatctgaatagcaaagtgataaattactgctagtctgaaataatttccttttctttggaaagagaattttaaaagtacttacatatttgcatagtgaaagatttaaataaaaatttcttaaagtgaaacggtttagcataattggtggcatgcgcttaagatagtgccaaataccaaaaggcacaggtgcagacgatacttaaacaatagtgctactacgccacttcgtgaaagctaatatctctttaccttgcatttgggcatgttgcaaacaggaggatcaaaatacaaatggaatcaagaatgctcttctggtatgatactttttgtttttcttttgagcccatgcgtacatttgagctgttgaaacagtcaaaaataaaacggcaaataaattgaacttgaacacaaaagtaaaccaaatccaagaccaaacttcaaaagtatagttgggagcaacaaaaagattgaaaataccttgattcaatgggacacggatcttagcgttaccatgcttcttttgatagtcaccccataggcgcaatttaatgtggcaataaaagttccatagttctgaaagcacgaaaagaccaattaatgtactcaagtcatccaatttcaaatatgaatagtatttgaataacttagcattcccaaaggggaagccgtagccaaagtaaccgaatgaaatgagaccgcttagaacccagtaatggaaacaatttttgaacaggttgaaaattggcatagtagctaaagagaattggtgaacaaataaggtttcaaataatctctttccataatgtcctaaaattaaaaaatatgcaaccctgtttaaaaatggattatagtcggagctagcactgtgccatctatcaacaactgtgggaatggtagatagataataaaaaagggagtgaaccaagactggacccaaatactcacaaaagaagactaatctccatgaaatttggggacccaaatctttgatgaagaattccattgagtcatcagcctcttcttgaaaaaacgattctgaaataaccggaacttgtttagattcctttttgtaggttaatcttatcctgtacttgctgatattgtggttattagcagagatttttttcaaaacatcatctaaagtaggctttttggataagtcaatttcagtgtcccttaaccctttagagcggctttttatggtgataggcattttcaaattaaattcaaaatatgtatctctctcaaatagctcaattggtttctagatagctaaatagaatataatcttactgtcctccgttctgtaaaattcacgctcttagtcccttttcataattccttaactttttgcgtacaaaatgatatgtttattatatttttcttttttttttttcaaattttttctttttcttgaaaaatttttcaaattggaaagctcatctctcttgaatgtataatactttcttcctctaactttcaaaaagttttacatagccaagaagttttccttacatcggtatactactgttatataagttattcttcgagaaacaattagatatcattcatcggataaatctaagttgcccattgctttcaataactccgatcaaattaactcaaatcaactaaaacagtaatgtcattcagaccaggtagcagaggtggttcccgtggaggttccagaggtggcttcggtggtagaggcggttcccgtggtggtgctcgcggtggttccagaggtggcttcggtggtagaggcggttctcgtggtggtgcccgtggtggttccagaggcggcttcggtggtagaggcggttctcgtggtggtgcccgtggtggctccagaggtggtagaggtggcgctgctggtggtgcccgtggtggtgccaaggtcgttattgaaccacatagacatgccggtgtttacattgctagaggtaaagaagatttgctagttaccaagaacatggccccaggtgaatcagtttatggtgaaaagagaatctccgttgaagaaccatctaaggaagatggtgtcccaccaaccaaggtcgaataccgtgtatggaacccattcagatctaagttggctgccggtattatgggtggtctagatgaattatttattgccccaggcaagaaagttttatatttaggtgctgcttccggtacttctgtttctcacgtttcagatgttgttggtccagaaggtgttgtctacgccgtagaattttctcacagaccaggcagagaattgatttctatggcaaagaagagacctaatatcatcccaatcattgaagatgctagacacccacaaaaatacagaatgttgattggtatggttgactgtgtcttcgcagatgttgcccagcctgatcaagctcgtattattgcattgaactctcatatgttcttgaaggaccaaggtggtgttgttatctccattaaggctaactgtattgattctactgtagacgcggaaaccgtttttgctagagaagttcaaaagttacgtgaggaacgtattaagccattagaacaattgactttagagccatatgaaagagaccattgtatcgtcgttggtagatacatgagaagcggtttgaagaaataagttgaataaaggaaattagtcaaaagtttctggtagcttgctcaattattagcagaataattgtttcgtttatatatatttcccccattcagtttcacttcctatttgaagtttttgtaaccctcgactttgtaaaatagatattactaaattcttttagagaacaaaagtattgtacgtattcgccatataaaaaaaaaagagtatatgtggtgactttttggtcattaattgttaagagcaagcaagtagaaatcataatcatatttcgagttttttaaaggtaggaacaatatcgataagctgttctccagtctcgacactgtttgatgaccatatatcattaattcttgtaacactacatcatagatttctctttatccttggattgaatctgaaaaaattttgatagagtcttttgttcaaagtgtcacttcttcatctgtcactcttacgtatttttttttttttggctttgcccataagaaacatcactgtatacgcaaggtcgcaatatttactatttaacatggatgagaggcagtgtgcgaccaaaacgaagacttaatcattaagaagagcgtgtgttgcgttgattggtaataaccaagtcgaaatttgcactaggagcttcagtctaggagtgaacttttgaaaagatttcagtccaaaaattattatttggaacgcggagctcctctaatagtcgaaataatagaatgcatagcgatactaacggtcgaacaaagagcaataatagcccatcagacaataatccaaatgagacagttatattaatagatagtgataaggaagaagacgcttctattcgcgaggctaaccttcctgtgaggttgtacccagacagacgggtagggagacgacgtgatgctttaaataggtttgtgaggtcagattcaaggagcaggaattctcaacggactcacataacagcaagctctgagcgccctgattttcaagctaataacgacgatatcactataatacgagaagttggacggttttttggagacgatggacctattgatccttctgcacattacgtcgatcttgatcaggagccaggttctgaaacgttagaaactccaagaacaatacaagtagataacacaaacgggtacttgaatgataatggtaataacaatgaaagtgatgatggcctgacaatagttgaagagagaacaacacgacccagagtgacactgaacctgccaggcggggagaggcttgaggtaactgcgacgacaacagacataccgataagaaggtcatttgaattccaagaagatctaggcgcatcacgcaggcagttactgagaaggagtgctacaagagcccgtaatttatttgtggaccggtctgatgaaaacgatgaagattggacagatgatacccataatttaccagaagctattcaaagggctcgtagggagagccgtatgcgaatgagcagacggattgcagaaagacaacgtagggtacaacagcaaagggtgtccagtgacgaaaatataagtacatctattaggttacaatcaatcagggaacgaatacaatcatatacgcctgatattcgtagtgcttttcatcgtgcagagtcactgcatgaattcaggtctattttacaaaatgttgctccaattactttgcaagaatgtgaagaagaactaatggcactcttcactgagttcagaaatcaactgctgcagaattgggccattgatagggtcagaaatactcaggaagaggccttgagacttcaccgagaagcattggaaagacaagaaagaacggcaggaagagttttccatcgtggcacattacgtgaatcaatcacaaactatcttaatttcaatggagaggatgggttcttaagtcgtttgtggagtggcccagcattgagcgatgctgacgaggaacgacacactcaaaatatcattgatatgatccaagagagagaagaacgagagcgggatgtggtcatgaagaatctaatgaacaaaaccagagcccaacaggaagaattcgaagctagggcagccagcctacccgaaggttatagcgcgtcatttgatactacgccaaaaatgaaattagacattacgaaaaatggtaaagaagaaaccatcattgtgacagatgacgatttagcaaaaacactcgaggatattcctgtttgttgcttgtgtggcgcagaattgggggtcggaataccggatgattttactggaatcagtcaaaaggatcgtggtgtttcatttgaagggttagtgtcaaaatacaaattccactgcccctaccaaaccctagccagaccatcaatgcttgatagagatttatcaaaacgaacgtttattgcatcgtgtggtcatgcattttgtggtaggtgtttcgccaggattgacaatgcaaaaaaaaaatctaagatgcccaaaaagaaactagctcaactaaagggttcggctcatccggataattatggccccaaattatgtcccgcagattcttgtaagaagcttattcgttcaagaggcaggttgaaggaggtttacttctagcacgcggtttaatttttataagggcattttcgaacttatcatcattatatattatctacttgcatgaacactttaatcacgcttatttaattaagattaaaagatcagaggtgcaattgtgctttgttttatatagtggatttgtgtgaaagggtttgctcccacaagatatggagatactctaaaacagcatatccaaagtacagcataaacataaacccgctagacagcccgctagacagtcttcatttccagaactggccggttgttgttggacataaatgggctgctgtgggtgttgttggtaatattggggctgctgttgctgatagtattgaggttgttgctgatactgctgctgctgctgttgaggtggataatagttctgttggctttgcgatggagcgtaacctctagacgccgtttcatatcctggtggtggagcgctaggacgagaatactgaatcgaaagtgatgtaatgaaaatacaagggctcgttagtacgatgtgatcttctaaaggcaaaacttgtaaaattaacgtacgctttgtttggaggcagagtttccgtaataatcttgagctgacatgagatgtgtatttgcttggtttatgggctattgtatgggtttgtcttaatatccttttcggttgcgtaaatactttttatatttcaatatttcacgatgccgctgatagcatcgtttaatacgaaaacttcgagccatttaccaagaaatattctggactaggtggaaggaagcttcgagaactcaccgtggctattcaaggctgatggacatatgtactgggctgagcttaagatctcccattactgctccgtggggttttatgtgaaatgtggcgtttcagcagtttttagttggctaatttcctaaaagtagtaattagtttcttatgatggatttaatggcgtagttcatccgcgtttaatttaactagaggataatctacttgcagcatgaatgaaaatagtaagccagtaaggatgcactgacagactcagctaccgattagtgttgttgacttttccgcaagatccttttctccctctttggacctagtcatccctccacacaagattcgctcttaagtagtggcgcaggctgttcgcttttaagcatagtgcttaatgtcgaaggctttatagatcccaaatactacgccttgagaaattgaatgcactagcagttagttaactttctggaacgcgcatgacgcgtcccggggcgcctgaggcggagcgttcgcgaaatcgggaaaacattatactgggaaagatcactatctattctctaaatgaacttttaagcaaattatcgtaagatagaaaagacgaaaccttagcaacctagcggtttaatatagaaacaattttattatgataccttccaataagagaaatgctagaattttaagcattacaacgctattattgttgttagtgtttttcgtagcgcaaaatgcgaacttcttgacggtagagataaaagaggaaacttctaaagcatttagtactaatatggacaatatggctggaggatcttccagggaatatgctgctatgccgacttctaccacgaataaggggagctctgaagtagacgaagaaattaatgaaataaaacagaaggtgggactccaacagcccatagcatcggttgatgatagtttgtcggccattaaaaacgataaagggtcgcgaataaccaaagcttttaatgttcaaaaagaatactccctcatactagacttgtctccgattataatatttagtaaaagcacctgttcatatagcaagggcatgaaggaactgcttgaaaatgagtatcagtttatcccaaactactatattatagaacttgacaaacatggacatggggaagagctgcaagaatatatcaagttggtgaccggtagaggaactgttccaaaccttttggttaatggagtatcaagaggaggtaatgaagaaatcaagaaactgcacactcaagggaaacttttagaatcattacaagtctggagtgatggtaaattctcggttgagcaacgtgaaaaaccttccaataattgaaattgttacaaaaaggaaagaagaaaaaattaagaataaatatataaataaagaggtcgtgaatgattaggtcgtgaaatgcagtgtagttggaaaggcgtagttttcctagcacaaggcgtttcggagttggaataaagaagctatcaccaacgaagaagcttttttgtccaagacatctcttaaaagggttgtgaaaacataaaacgcttaatgccttcatatatacatatataagtttatggtttcgatgtttacaataacttctatcctttgctggtccatgcacttcaccttggtaagttatgcaacgcacttttgtctacgcctgcattcgatataaagggtaagctgccgagataacttttgtatcttccgtgtctgcagataaaaaaataatgcattcttcaaaaactttgtacaatatcgggagagtttaacaagcaaagtggcaatacagattataaaaatatgaaagttaaaataaacgaagtgcacagtgtgtttgcttggtcatggcacatccctagcacatctgatgaggacgcagccaataacgatccaattggcaatgatgaagacgaggatgtctgtggtatctgtcgtgccagttataacggtacctgtccaagctgtaaatttccaggcgatcaatgccctttagtgattgggctatgtcatcataacttccatgatcattgtatataccgttggcttgatacaccaacctcaaaaggactgtgtccgatgtgtaggcaaactttccagctacagaagggtctagcaattaatgacgctcatgtccaaaagttcgttgaaatagtttcaagaagaagagaagaaatgatagaggagggcgtcgcagaagagtttgtggactttgatgaaccaataaggcaaaacaccgataacccaatcggtagacagcaagttgataccatcctggacgaagactttttgttacgataaaaaagaaacttagaaatcacaattagctatatttccatacggttcttttcttgtgaacgctgttaacattctgtatacttaaatgaaaatttaatattgattttttcttgttgcagctaaagataaaaaaattttcttttccaatcgttgaatagatgtactgtagccggaactgaagttaaggttgttagattgaaaaagaacaacagtgtactaatcatgctaacgatgacagcggtatcgttgcatacttagaatacataaaaatatgcttccaatcggatttgaaccgatgatctccacattactagtgtggcgccttaccaacttggccatagaagcttctgatttgtgttcatttgattgtaagttagagtatttcaagctctaactcaattatgtgaactttcataaaattgtgttatttttgagaaatatgtgagttgttagataattgttgggattccattgttgctaaaggctataatattggtatacagaatatactagaagttctcctcgaggatataggaatccacaaaagggaatcgatagttctacataatgttattattttatcttctttccttttatgcgttgtcattcattatcctattacattatcaatccttgcatttcagcttccattagatcggatgactgtttctcaatctttatgtcatcttcttacaccgcatgtgataatataatattaaatagatgatattagagttcaattccaacaattttcattctagatagcgggaatattactgggtattcagtatatcacaacgtctcttacaagatagaggatactacaagagggaagcaagaatcatacatggtaatgttgttttttcttccccacattttttgttatcattcgttatttattatattttcaatgcttgcatttgcagcttccatctcatctgatgactgtttctcaattcttatagtgtgttatcatgtacggtattagatgatgacataaggttatgagaaattgtcgtcgaagttaaaggaagctgtattctgtatacataatactatagaatttacaaacagtggaattgcaacaattatcaaattattcacctaataatcacctttaacattcagggaggtttatttttgcttccgaaatttttacagtctacagggaagaaataaatatttagttgagaaagttttgtttatttgtaagttattaatttgaaaaataaataccataactagcgcaaagcttataaaagagatgtttgttgaaaaatgcagaaaccccatatataaaaccatgaaatgtcacaatggacatgatgtacattcttggagataacatcatattcgaaatattcaatatgcccaattggtacctgttctccataccccattatatgatacaaatgatctgcccctattctaacactgtgctagcaacatagcaattatactaaattttttcagtcactatgcaatacatgtaatctctcaactaccaagcagtcattattctattaatatatatttgtgcttggaagtattgtttcacttctcagaggcctttcttgacatgttatagttttttaggtaccttctaatcctgtaaatttatacaaaaattggtatataatggctacctccggaaattttaacaacttttgggtcacactattactgtgtatacttcctttagagatctcaagcattactgaaagataacctgaggaaaaacatagcgcgtctacggatgtgtaatactcgctggatttcctggtaaaaactactgtacatttatcagctgcctctgccaatgctattgagaaccgtaggttcattagaattacttcattcaacggaaaacgtcactatacctgccgcttgtgtgtcgcgtcagtaacgccttgacagaaaaagaaagaaaagaatatgaccgaccgatcgatgtattattattattgaactgattataaaaaattggaacgtcgtagaatcagaaatcataagacaatggccaactatgccaaatcacacatcaatatttaaccgagatagcaaaagaaaataaatttcgattatttttaaaatgtaactgacagtttttggcacttgtggacttcctctttccggcagatagcaaaaccaacggtagaatggccccgaaatttaaattttatttcattgtgtgcttgagcgtggcctttttttttttttttttacatatcacaaacaattcacacattaccacacataccataagctaacgtatgcggtgcaaagttcactattaggcgcttaaaggcttggaacgaaatgacttctggcttttgtttcctatacacattcttagcaaaacttttggtgttgtaacaagcaatgagatagagaaagaaatatatccatcaatggaagaaataggcagacgtcggtaattttattctattgaaaatatgcaaaagtgacagtataaattgaagtaactaattttacatctagtaagctgctgttgaagaattgaatagtatcgcagtatttattttgtatacccttagaatacacatacttggtgttagaagccatctaatacactatataactcggggattaaatcatcttggaagagcgaatctagttcaggatcgcctgtcgtaaagttcgaggataaggacatcgaatttagtagtagtcctaatgactcgatgttattgtctaaaatttgttcaatttcttttcctgatttatcatcgtcttcttgaataggtaaacagtaatatttaccaaagttcaggagggttaggatggtgtgaaaaattataggaaggaacatcaagaaagtgcttgaaatatttttcttggattatggaagtatcaagaacgatattatttcaataatgtgatggtttatatctttgcatacaatagattttgtgatactttttttatgtaatggtcccgtaaccccgtcgctctttcccttttaattttgcccgatccactttctatgccggtagtttagccgccaagtgctattttcaaacgaatcaatagtagcggctgcaactttgaaaaagaaagaaacaaaattatgcgctagttttccatttcttgtattcttttttcttttgcggtggtaattacgggaatttagtgatgttggaacgagagtaattaatagtgacatgagttgctatggtaacaatctaatgcttacaccgtatattaatgtacacctcgtatacgtttaagtgtgattgcacctattgcagaaggaatgttaaacgagaagctcagacaatactgaagctgtgctaaagatctattaattgaacatgatatggtaggtacatatatgaggaatatgagtcgtcacatcaatgtatagtaactaccggaatcactattatattggtcatgattaatatgaccaatcggcgtgtgttttatatacctctcttatttagtataagaagatcaatacttatttcttcattaatactattttttacctctaactatcaacaagtgataattgttggaattccattgttaataaaggcaataatattatgtatacagaatacagcttcctctaacttctatgacagtttctcataccttatgtcatcatctaacattgtacattataatatactcgtagtaagactactagttgagagagaatagttgatttttattctaacaaataatattccagcaggtttacatattcctaggtttgggatatatcttaagtcaataattcatcattagtaaggcaacttggccgagtggttaaggcgaaagattagaaatcttttgggctttgcccgcgcaggttcgagtcctgcagttgtcgtcatttttatattcccaatatttttatcactccgggtaacgagttattaacggtttttctccggtggcaaatgtctcttttcttttacctaaaagaaggttaatgtgaatattagtgaatatgatgcgtatcagtgtcaagcttacagtcaattcaagttaaagaagagacagcgtttttaatagaaaataaaatgggacaaggtgtatcatctggacaagacaaaaagaagaagaagggatctaatcagaaacccaaatatgaacctcccgttcaatctaaatttggtcgtaagaaaagaaagggaggtccagctactgctgaaaaattacccaacatatatccaagtactcgttgtaagttaaagcttctaaggatggaacgaattaaagaccatttgttattagaagaagaatttgtctctaactctgaaattttaaaaccctttgaaaagaagcaggaggaggaaaagaaacaattggaagaaatacgtggaaatccattgagcattgggacccttgaagaaattatagacgatgatcatgcgatagtgacaagtccaactatgcctgattattatgtatctatcttatcctttgtcgataaagagttactagagcctggatgttctgtgttattgcatcataaaaccatgtccatcgtaggtgttttacaggatgacgccgatccaatggtttcggtcatgaaaatggataagtcgccaacagaatcatacagtgatattggtggcttagaatctcaaattcaagaaataaaagagtctgtagagttaccgttaacacaccccgaactgtatgaagagatgggtatcaaacctcccaagggtgtgattctttatggtgcacccggtacaggtaagacattgctagcaaaggctgttgcaaatcaaacatctgccacattcttaaggattgttggctcagagttaattcaaaaatatttgggggatggtcctaggttgtgtaggcaaattttcaaagtagcgggtgagaatgcaccaagtattgtatttattgatgaaatagacgccattggtactaaaagatatgactccaatagtggtggtgagagagaaattcagagaaccatgctggaattgctgaaccagctggacgggttcgacgacagaggggatgtgaaggtgattatggccactaacaaaatcgagactcttgacccagcattaatcaggcctgggagaattgatcgtaaaatcttatttgaaaaccctgatctaagtactaagaaaaaaattttagggattcacacttccaagatgaatttaagtgaggacgttaatcttgaaactttagtaacaacaaaggatgatttgtcaggcgccgatatccaggcaatgtgtacagaagcaggtttgttagcccttagagagagaagaatgcaagttacagcggaggattttaaacaagccaaggagagagtcatgaaaaataaagttgaggaaaatttagaaggtttatacttgtgatgtgcccatttacatttttctataatagatttacgtatataagtaatgcttcaacaaagcttaatatgtgtacattttgtatcacgtgcaatatttgtttcaaaaacttaatataggtagggcgtcggggccttcgcgaattctaactgcaaaggaaaactggtgaacacatctgagagggtttgttgtcctaattttataggaaactaaaactcaaaagacaaagtatacctttgcaaattgaaagcttagttaaacattattattcgtgtgtttgaggtcactttttttcgtcttaaacagctctcaaagttgtctcaaaatttttatccggattcctttacattaacagaccccaaacacaacaagttttgatagtttaagtaagtgaacgcttatttttgttgtcgttgaaaagaaaataaataggcagtattatcaattaggaggtgagttaaattccattctataccgagtatacgagattttgcacattcttacttcatatatcatttaggcactgcatttatcttttaaaaatcattataatgagtaatcattctgaaatcttagaaaggccagaaacaccatatgacataacttatagagtaggtgtggcggaaaataaaaactcgaaatttcggaggacaatggaagatgttcatacgtatgttaaaaactttgcttcaagattagattggggatatttcgcggtgtttgatggacatgctgggattcaggcctccaaatggtgtggtaaacatcttcatacaattatagagcaaaacattttggcagatgaaacacgagatgttagagatgtattgaacgattcattcctagccattgacgaagaaattaatacaaaacttgtaggaaatagtggatgtactgctgctgtttgcgtattacgttgggagcttccggattcagtttctgatgattcaatggatttagcccaacaccaaagaaagttatatacagcaaatgttggtgattctcgaatagtattgtttagaaacgggaacagcataagactgacttatgatcataaggcatctgacactttggagatgcagagagttgaacaagcaggtggcctgataatgaaaagtcgtgtaaatggtatgctggcagtgacgagatcgttaggggataaattttttgatagtttagtagtgggcagcccatttaccacgagcgtagaaataacttctgaggacaaatttttaatcctagcgtgtgatggattatgggatgttattgatgatcaagatgcatgcgaattaatcaaggatattactgaacctaatgaagctgcaaaagtcttggttagatatgctttggaaaatggcacaacagataatgtaacggtcatggttgtcttcctctaagaaggatccgttataaaccgcgcaaaaattatgcatagacatagagatatgcaatgtgtatgtgtgtatgtatgtatatgtataaacgtaccaaatctattttgcatgcatctctcacatgacgaatgaggttttagtagaataggattccagatttttaaactggagaacatattctatcatatatataccaattaaattcacgtagcgaatgcacaacacggtttacaagtcaatagttaacaataggaagaccaagctatatattgaagccgctgaggtctaattcgccattatctccagtggtcgaccagtcaatattaaggtcgttgaaatcatttaatgtcaagtattcttcaccgttgtcggctggaggagggttatctccaggattggaaacaacggtcgttggtaaatcattattaactatattttcattatcatttccggtagtgatagaattgttcttgttattgctgtcgttgttggtggtattgttattgtcgttcccactgttgttgttgttgttgttgccgttatcgtcattgttgttattgttattattattattattgttgttcttctcactgctgttgttgttgttctcgttgtcctcgttgttgttcttattcttttcatcgccgttgttatttttgttgctttcgttgttgttatccttgccgttcttggtgctattgatattattatttatgttgttttcaatagaagaaatatttatgtcattgtagttgttacctgagtcattatcgtcaaagcctttggtttcgtccaccgtggcattgaaggctgtggagtcaaaaccagtactgtcaaggcctgaaaacatcgaaatatccatagagtttaaatcgttgaacattacatccgagggttgggcctgctggctttggattcgagtagtggttaagggagaaaatgcggcaccgttattagcagcatttgcgttctcaagttgtgtttgactggatgattgaagagatccaagttcttgataattctctttggaaccgttggcatccgttgtgttcgcaggtgctgttgtggagaagttcaaaccaaggccatttttttcctttgaattttgctggagttgctgctgttgggaggcttcttcgagttcttgtcgcttttttaattcttcttgttctctaaccttcctcatattttcttgttcagccctctttttttcagcttcctctctttctttctccttttcttttccgagtgcagtaagagtttctaaatatgaagaactctggcttagagaagtctctaaatcatctaaaattccatgaaataatttaaccttctctttcaataatttttgctgagattgactgaaaccattgacgagataagaatctagttgtacattttttaactgttgttgcatcatcatttctgctccaacttttaggatgtcatcgaagcaaacagtaagcttatttttatacgtcattgttctggtattgctcccccgttcagagaaattggctgtgtgaacagacgaaactgggctattttgtactaccattactttcagacgggcagtttatttgggaggatccgccttcaaatttaaactatcttgagaccagaacatctattgaaattttggtgaatattccagcaaccctctctatcccgctttgaatttcttgatgtcattggaaacatttaacttttctcgttacaagcgggtaatatcctaatcattgtaattaagacgttgcttccctgggaagaaaatagtataaacataagatataatagtttttaaaatggtcaacgtatgcgatgcacaactaaaaggtaccaattcattaaatattataatatttacttcttactattacacgaaagacaagtgtgaaatgcctaggagattgatgattgacaagctctggccttgcaataaaaatacttatacacaacttcaaataatatagaaaagaaagaagactataagctaaaaatgtagacaacctcatttaaatattattcttaggacttggtaataatagctaatttgtatattattcacctcggtcaccgcctgtaatcacctttaacgaaaatagatgcccagccaatcaaagcgcattatggagtcgtctaggaaggggccgtcccatcattgtaaaagttcatgttaaattagatggaggataacaataaaggtatcgtacacacactgctaaaagagcctcaatcaatttgtgaaggtataactgtagccgtgaggataggaaaatgttacgttcaattattggaaagagtgcatcaagatcattgaatttcgtcgctaagcgttcatatgcagaagctgctgccgcatcatcaggtttgaagttacaatttgctctaccacacgaaactttatatagtggctccgaagttactcaagtgaacctgcctgctaagtcaggacgtattggtgtattggccaaccatgttcccaccgttgaacaattactaccaggtgtcgttgaagttatggaaggctctaactctaaaaaattctttatatcaggtggatttgcaacagttcaaccagactcgcagttatgtgtaactgcaattgaagcttttccattggaatccttttcacaagaaaatataaaaaatttgttggcagaagctaagaagaacgttagttcatctgatgccagggaagccgcagaagctgcaattcaagtagaagttttagaaaacctacaatccgtattgaaatagcgtttttatggtacgcattctagaacttgaggggaagaagtctacgtttttaagtgttgacaagcaattcgcttgaaagcgccaaaattcattgtttgttctactcgaatttaagtttccattttggttgatgtcttaagtatacagagaaaccgtttattagcgtatatatacagaaaattttattattttatattcaaaaacaagaaaacaaaagagaaaacattaacatgtaattttcataactaatagtcctagaaagtaatactttttacaactgtttctttaaatcctgtatgaaagccctagttgcagatcatcgtgttattccagtgagttttcacttccctaagtccttcctatttatgttttagtccttcttgcacagcaattttacttcgggcactgttgccgtatattctaaaaaaatgaaaaaaacgttcatgccccagcgaaaaccagtgtttcctcgtattcgtgtcagtaattacaccaaagtttgttctacactaaatcacgaataaagtgggagattgagttcaacaaaatatctgattataaaagtatgagaacaagaaaattaaggagcctccataataaggtgcttttaattgagaatgaatgttcattagttgctatattgatggtgatggaactccaattacctaatcaaaaatatgaatgtttatgcgaataagagtttgtaaagaaaaagatccctgtagactggatgtgagatgatgatttcattcccggcctcttaaataaaaacaattaccactgcaaaaatgttcttcaaacgcgtttattatataatgaaaaagaaattcaaatttttcgcgtttgaaaatttatgctaaacaaataactcgaggagggacgcgtcgagaaaatcgcgtctttctactctcacagtgcttgcatacgtatggtatacagtatcaaaagtagcagaatttgtcttcattatgatatatatatatatatgtacatatatatagggtgctaaaaagtattctttttgctattattattgcttaaatcgccgacctttttcccattgtcacgagaacataattgttaaaccaataaaaggaaaatccataacaaaaaaggactggtcaaagaaaagacaactcaattgcacaattactttacaagaaacacgacaatggttacagaaaatcctcaacgtcttactgttttaagacttgccaccaataagggtccattagcacaaatatggcttgcttcaaatatgtcgaatataccaagaggatcggttatccaaacacatattgctgaatcagcaaaggaaattgcaaaagcttctggctgtgatgacgaatcaggggacaatgaatacataactttacgaacatctggcgaattacttcaaggcattgttcgtgtatattccaaacaggccacttttctccttacagatataaaggacacattaacgaagataagtatgttatttaaaacaagccagaagatgacttctacagtaaacagactgaacactgtaacaagggttcatcaattgatgttagaagatgccgttacagaaagagaagttttggtcaccccagggttagagttcttagatgatactactataccagtgggcttaatggcgcaggagaattcgatggaaagaaaagtccaaggtgctgctccctgggatacttcacttgaggtcggtagacgattcagtccagatgaagatttcgaacataataatttgtctagtatgaaccttgattttgacatcgaggaaggtccgataacttcaaaatcttgggaagaaggaacaagacaaagctcacgcaactttgatacgcacgaaaattacatacaagatgacgatttccctcttgatgatgctggaactattggttgggatctagggattaccgaaaaaaatgaccagaacaacgatgatgacgataactctgttgagcaaggaagaaggctaggtgaatcaatcatgtctgaggagcctacggattttggatttgatctggatatagaaaaagaagcacccgcaggcaatatagatacgataaccgatgccatgacagaatcacagccaaaacaaactggcacaagaaggaactcaaaattactgaataccaaaagtattcaaatcgatgaagaaacagaaaattcagaaagcatagcttcatccaatacatacaaagaggagagatcgaataatttattgactccacagcccaccaattttacgactaaaagattatggagtgaaataactgaaagtatgtcctatttaccagatccaatccttaagaacttcttatcctacgaatctctaaaaaaaagaaaaatacataatgggcgagaagggtcaattgaagaacctgagttaaacgtgtcgcttaatcttaccgacgatgtaattagtaatgcgggaacaaacgataactccttcaatgaactgaccgataacatgtcagacttcgtaccaattgatgctggcttaaatgaggctccttttcctgaagagaatatcatcgacgcaaagactagaaatgagcaaactaccatccaaactgaaaaagttcgtcctactcccggtgaggtggcttctaaagctattgttcaaatggcgaagattttaaggaaggaattaagcgaagaaaaagaagtaatattcacggatgtactaaaaagtcaagcaaatacagaaccagaaaatattactaaaagagaagccagtagaggatttttcgatattttatcacttgctacagaaggatgtattggtttgagtcaaacagaagcattcggaaatattaaaatagacgccaaacctgcactatttgaaaggtttatcaatgcttaaaacctagttacgccgaggggatttcttggtggacccaataagctgatgcatatatagatcaaagactttaatttataaaattgtcaatatttaatattaatattcacaaaatacgataaaattcaaactaatgcggtagagccactactggccgcaaggcagaatgatcttggcaactctacacgctggtgcatgggtagtatttattctaaaacttgctgtattattttgaatagtgatattaggaatcgtctgcccacgtacaccggtgaagccgaaattttctcatggaaaccttgggaatagaagaaaggtccattgtaagtgctacatactgaccatcttacataatcttacacaaccctggtaataaagccacgtctagaaagttttccaggccaaacaatcttcttttccattagctttggtacattagcagccagaggaaacattatgcagtttttaaaggctcaactttttatctaatatacaaaacaataaagttgaacaatttctggataaagcgcctagaacgtcttacgatatcttcaaagaaaatagaaaaaaatggaatttttaatttttagttagaggaaactaaacttccatcttcacctcctttagaatcagctacttttgtagatgatccttcctcgttattttttatcttctgttcattctcttctttatcatcatccgcatctatattagatatctttttattatatatttccatttccatctggtatctttctctgtcctcactataaagcttatagtacggtttcctatcttgttcgttaagatttttccaaccttctgccagatctcttgtcacgtccagagagccattctgcctaatcctttccttattcatttcacagtacaataagtatgcatttgtgggcctcttgggcatattcggatctctttcctttactttgtgtcttttagttttagattttcgaaatggcttcgtcaatagttcctgtttgaaggaggccagagtcggcaatggatcctcacagtttaactcaggatcaagttctatcctggattccaacctctccagtaaaacaccgtattctaatttgagtcttttcaccgaaagtcgtgacctttggattgcaagtccaagcaccacattctgatctttcaattcttcaagtctgcgctttttttcttcaactgacatttcttatgtgttactattacctatatcctggctgcttctcatccaattctagcccctagaacgatttaatatatatgtgcgtggtaatcatttccttatattttaattgaaatccttcctttctcagaagaaaatcttttttctaaggaaaatggagaaccgtcggctccttttgctttactggtgtattcttgttttttctgtttgataatgcgatttagggcgaaaaactgctgacaataccttgtccgctttcgtgcacaagatttcttagcacgaaaatatatcaagtaaccgtaaaattattcctttgccgactatcaccgtaactgcggctaaacaaatctgtccaactactactcagcttaaattagcattttaaatacatttaatattcaattagtcatggtagatagtaatgatgatcaaccggaacgccatgcattacttcataatgacatccaaacatcaaataacagtaggccatcactggtccaaaaaaagtacttacctaccccacaagatacaagaaagtctagagcatcgtatacaggaagtgccatgatcaacccgacaagtaaacaaagtcgtacaggatcgggcgctcaaagaacatcacgcacagcacagaaactaaaacttttgccagaagaaccattccaaagagatagcgaaagacttactgatttaaagaatcaggaagtatattctcaggtaaacaggataaaagataagcctgctagaagggatgctgaaaagttgggaaaagctcacagacatttactccccaggtcaactgcatattgtactgctagcagttacaatatgaaagagctggtaaggtggttaaaggactgtcgaaagctacatcatactcatcctaaattgtttgatgaatgcttgtacactcccttcatttacaacgattggaggggcgacaaaagatttgaggatgaagatgtgattaggttggatgatgagggcggtgaaattattgttagtgacaagcacccagatctgtttatctttgaatatggtgttgtcgttatgtgggggtttactgaaagagaagaaaaagctttcttaaacgatatagaaaagttcgaaaaagaaaaattggcggaagaagatattcaagttgaagagttcaattattatgtcacaaaaagttatcaaccaagaatatataacgattttattaccttgagagatggttcaaattacatggtaaaactctctatctctcatgcaattgctcaaagcgtaaaaatttcacttttcgaagagcttgtggataatactattgaagatactcaggatataccacaagaaattgcatacagcggtaaagtttctatgagcaaagaagatataatgaaaagtataggggagctattcattttgaggataaatatcaatctacatggatcagttttagactctccagaaattatgtggtcagaaccacagttagaacccatataccaagcaacaagaggttacttagagatcaatcagcgcgtttcacttttaaatcaaagactcgaggtcatttcagatcttcttcaaatgttgaaggaacagctgggccattctcatgaagaatatcttgaatttattgtcatattactagttggtgtggaagtcctaatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcacattagcatacatatattacacgagccagaaatagtaacttttgcctaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaacctatactaaaatttatgccagttaactatgagataagcaagtatcatctcatttcattacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaagcgctcttcttgcgtgactgttcatatacttcaaaccaagaatgtaactggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaatcttttcttgtctgattttggccatttctttccacatagctgaagttgttatagaatggtctaaaggatcttcatatttgtcgtcgcagaattcctttatgaagtctgcaatatcaatctcgtatttgtaaagaagagaattcaggtcaatagtggccaggtaggcacatacgccctcaaacctatatgtagtgtcgtgtccagattctctaacgccacggtcatgaagaaaaaactcatccaatttaggctcctttatcttaccatcgttataaagttgcttaaattcgtctaaggtaacgccgtgtttcgatgcatatggtagtaaaacggtatcgaagtgatcactttcagtttccggaggaataccgagaccgttaggatggtacctggataagcctgtttcgggatcaagccttggagatgcggtccaaacagttttgtactcttttatgcttgcttggaaagctcttttcaacaaatccacagcatcgggattactcctaccaccaagttttttgaatactaccaaggccatttcagtcaagaatgggggctgtgatctacatagatagtagcttctgttagcattcaatatttttccatagtgattaatctcaaaaataaaatgctccaccatacctcttgcaacatcagtcttgttggcttctaggagacctagtgccatcatataggagtcccaaccatataattcattgaatctaccaccaggaacagcataagggtaaccaatgagagttttttcaccagtagaaggattgaagtgctcttccatagccaatgctagtaaaccgggggtatcattgacggatttgacgtattctgccgttattttttttggtaaatattcaacttctaatttcaaagatggatgcatttgagaagcttgaacataaaattcgtattgttctggacaatcataaggaacatagattcttggattttttgcccccggcgtatcaatcttggtatcttttgcaatttcgcctacgttgttcagatcaactctcctggtcaaagagttccagaactgtgtgtttatcaatcttgataatctgttgacgggattttcgtttatacgagcttcatctaagaaaatttggtgtctaccaaaacttttcgcaatagttagttcctgcaacaaattggataacatatacgtacccctaatattaatatgcttatagccataggagtttgcggtaccgactttcaaaacttttggaccggtatcctcgatggtgatctgataatttttatcggtatcctcagcagccagtagttcattaagtgttttatcgacatcttcgataaagaaacgacgattaccttgactacttgaataggtgtcatcctcagaaccacgtctagtctgttgaagtttaccaaaaccagttttcttgaaaggagatacattatcgaaaacactcatagtcctcgtacggttgatcttagcgggctttgcctgcttctgctttcttgggtctgttggggggccatagtagacttctgcgttcgaaaatggatcattgaattcacttagtgatgataatcttctttgacggccttgggctaccggtccttggcttgtattaacttgactcattctactgattttttttgttaatttttctttttttgtttatcaggcgttcttgtatctagtaatctccttatatctatgcagttggttgtgaaatcagtcaatataaaactatcttcttgatattatatttactctacggaaaacgatagggggaaaatttctagctaatgttttgcgatcttttcaggccaacaaatcttgtacctcgctcctgaaaaatcccgtaaatcggtgatcgcgcaagtttcatattgataaccttgtgaaccagtctatatatagccttatataagtactgctctatcaaacttaagattggtggccttcttcggtaactaggggataaggggcttcgtcctacacgatgctcctgtcgtttctttttttcatttcttttttcgcccagcgggaagtacgcggaaaacaagaaacaaaaaaaaaataaaaaaataaaaaataaaacagaaactaaaatctgatgatgaaattgatattcaattggagaaagaagaaagatcttgtttaatttgaaataaaagcaagaagataaacacaactatagaaaaagaatgtctagcgaagataagaaacctgtcgtcgacaagaaggaagaggctgctccaaagccaccatcctctgctgtcttctccatgtttggtggtaagaaggccgaaaagccagaaaccaagaaagacgaagaagataccaaggaggaaaccaagaaggaaggtgatgatgctccagaatcaccagatatccattttgaaccagtggttcacctggaaaaggtagatgttaagacaatggaagaagacgaagaagttctttacaaggtcagagccaagcttttcagattcgatgccgatgccaaggaatggaaagaaagaggtactggtgactgtaagttcttgaagaacaaaaagactaacaaggttagaatattgatgagaagagacaagaccttaaagatttgtgctaaccacatcattgctccagaatacactttgaagcctaacgttggttctgatagatcttgggtgtatgcttgtacagcagatattgcagaaggtgaagcagaagccttcacttttgctatcagatttggcagtaaggaaaatgctgataaatttaaagaagaatttgaaaaagctcaagaaatcaacaaaaaggcttagtttcgatgtgcttgttacttgcgtctagatttttttgttcctaatgtaattttcctttacagcgtgcatatatatttttatctactgtgaggaaaagttgctctttaattatataaaaaacgcttatgtagcattgtgaaatcacatatgaatagatatgtaagaaggattagagggttcaagtaattgttgcagtagtcaatgtagccaaatgtctaaccactttggtgcatggagattagctcaataatctcgtagtatgtttccgggtaatattctctgtcttatttaccatctttatgtttccgcccttttatttttgtttttctcgctactcctttataattactaatgagaatcgaatactatagaaatttttgacgtaataaaggagcagtaaatttggaatacattccttagctcgctagaaagctgaaggaaatttagctaaacagagagtatagttttgaaatgattttacgggagcagatcgacttcctaatacataaaagacaggatgataataataacaatggtgaagcgattacagatgatgatccatttagctcttcctcatggagatggggaagatggattttttttatttttttcatagttgcactccttatacttctgttttcaactgcaaaagtgaataggagaagaagaattatgggtcaagctccgattaggggaaccgcttggttaaccccgcctacctacaggcagtccgagagagattacaatggcacacagcgttgcgttgaagactatgttcctgaatatacagagacagcaaatgagaatgatttggggttttacgacgaacgaggagagtttcatcctaatggcaaaacggaatatttagcgccaccgcctttatcagaagaacaagctagctcgactgataaagacttacagcgcccagtggctgccgtcgtacgaattcctagtgaaagtgaattcgacttcaatctgctaagacccactatgaataatttcgttaatggtcagagtaatcgcaacgagcagcattctccgactgttgaatcttcttcctttgatgttaataacgcgccggcaagagcgaaagtgagtaagtgatttttcgtttaatgaatttattatcgcatgacttgcggtatagaaaatagttataagagtgctgaaaaaaaaaagaagtacagaagttttcgtttctttgaaagtcgcgattattccgagttgtgtattatagtaggaacatactattgatttaggtttgagagctggtagtatcgacgtccagaacagtcaattcatcggaacgctttcgactcggtccacggaaaagccattcaacgatttatacggacggtgattttgattagtctaattgcctatatattataaatatattcttcctttacctatttcttctcacacattatcctctaagtaacatgagaattcagatgccggttaatcttcggctttttcgcgttgaattcaaaaaatgaaaatgatgaacaaccactgggaattcaccatttttcaaagtgtgtaaattcatgcctagggccttatcaataaaatttgacaatacgtatatggacctttacgatgaattaccggaaagtaaactcctttatgatgaagaattttcatatcttttggatgcagtaaggcaaaatggtgtctgcgtcgtagattttttaacactcactccgaaggaattggcaaggctaatacaaaggtcgataaatgaggttttcagatttcagcaattgcttgttcatgaatataatgaaaagtacttagaaatctgtgaaaaaaactctatcagcccagataacggtcctgagtgtttcacgactgctgatgtagctatggatgaattattaggtggaggcatattcacgcatggcattacagaaatattcggagagagctctactggtaaatctcaattacttatgcagttggcgttaagtgtccaactttccgaacctgcgggagggcttggcggcaaatgtgtatatattaccactgagggcgatttaccaactcagagattggaaagtatgctatcgtctaggccggcttatgaaaaactaggtattacacaatcaaatattttcaccgtcagctgtaacgacctaataaatcaggaacacataatcaatgttcagttgcctattttattagagagatctaagggttcaataaaattggtgataatagattcgatttctcatcatttgagggtggagcttcagaacaagtccttcagagaatcccaagaaaataaaaactatctggataggatggcagagaagctccaaatactggcccacgattattcattatccgttgtggtggctaatcaagttggggataaaccactggctaacagtccagtggcacataggacatatgtaactgattatgattatcagctagggtggctagttggctggaagaactcaaccattctttatcggcagatgaattcgctgcttggagcaagttccaataacgatgaaattctatcagacgatgaagattatatgctaatcgagagagttatgagcactgtaaatgaccggaattatgattttttttcaaaaaagaaaccacccataattgagaataaaaccgttgagcgaaattcatcaagtcctatcagtcgacaaagtaagaaacggaaatttgactatcgtgtccccaatctcggtttgacttggtccaatcacgtttcaacacgaatattacttcaaaaatctttcaaggcttcaacaataattcaaagaggtgaagctcatctttataagggaggtgattcggcaagcttctggcaagttaagaggacaatgaaagtggtatattccacattcgctaagcctggtcaaattgcatatcaaattactaagcgaggaatagaaacagcctgattgaagttccgtattcgaaagaaactaagagctttgcagtaatatatgatgaaggcagtctttttatatagtagcgcacattattcaatcctcgctaaagtgttcaattagtaaatataatattgtcataaaggtacatagttgaaaagggtatttttttaaaaatagaaacttacaatagtagacataaagggactgtttttaacgattataggtgtaagacaaggaaaattcacaaattaaagtttaaaactactgtagggattcttcttgatctgatttatcatctattacattctcatcataagtgaaatcgtattctccttcgtattcatttgagccatcatctattataagctttccctgaggtttttttgccaaggcatcttccacttcgcctgtactcgaatttagacgcgagcaaatcaagtaaaggtaagccactcttttccttttcctgttgtaaagaaaacctataagattccaaagatagccaggctcatcttccaaaaaagagtttgaaggtgaatattgaaaaaggacgcaatcagaaagagtcatgtgagaattaattacctcccagacccattcctctggttgtctaccaagagaatataaggtgttttcaaatttggaaataaaagttttcaatgatgttttgacaaaatccgttggctcaaccgatgaaaaatcatggtcaggataagaagcgttgaggatagcaatcagataagcaaatattttgcggcttgacggttcgtttatgggaccaaacggacccaaacttaaattgcttggcctttcgtttatcgaagattttcttcttttgttaacattgttggttgctgtaccagaactgtaattattgttcgatgatttaccacttttgaaactgctaatactgctactgctccttcttcttatcctctcatcattcttagaagaagaatcaagagacgatgagctcatagagccagaatcgtaattcgagactaattcttttaaattttggtcatttagcttggcacttttgggaaaagttgctggagaagaaccattaggtccagaatagttattgttattactgctattgccattactgttgttagtgttattattgctattgtattcactaaaagatattcttctcttttgctcccaaaaagagttgctatccctcctattagaataaaatggcgacgagcagggtgattggtttgtttcgggagcagctagctgttgctgaagggtagcattgtaattctcattttcctgtaaaatagtatccaaatgctgatcaatagttttatataattttctatctgatgcaaccgcctttgttgtgaaaatatcgcaactgcccacgattttacagtcatttgtctcgaaattgagagtttgattcactctctctatatctagctcatcaataaactaaggaagaaaaggagggttcaggtacaatgttagtaatttcgaataaagagcatggcagttttagagtgataacatactttcattgtcgtgattctttaggcaaaaaaatccgtttggagtaatgagcggttaaacttgttcttggtgaagtgtgcagagtttctaaactttaagtaaatgacactaagcctatatttttcgcattgctaaagaaacactgatacataatgtgtctacattttatatagctgatagcacgttctttttaagttgaattatcttttttttctcttgttaaataagatggacaacgcgctttcgctggcgagatgaagcgcccctgattgacaagcaactcgtggaggcaagtaattagcgacgctttactttgtctgatagcagtaaatatgtgactgcatttaagaagtgaaattataagaaatgtacgctttaaaaatgatatatgaagttacataaagaaatggtaaaaaaatttttttttcctccattaccgataatagttatattccttttttattaactttatctcctaacatttcgatataatgaggaccgaatacggaccaatgaaggttgattaatgcatataagtggcgataaacattctcgaattcctccagctctgttgctgcgaataaacctctggatgcaatcgcattgccagtaggtgtggtggtggaggttttagaaggagacatcaaagacgggctgattttaacgctagcagtatctgtagtagtactcaaagtgttagtgctacctacgttgccattgtttgtgttgtagaggtacacaaagtcttgtttaacgcgtccatcaattgtgcactcggacctgttgaagatagcgtcctctagtgatttgaatactctattttctaggacaccataaacttcactgaggggttgagtttgcttagataaccaagatttagcaaaggttatttttgagttgtctaatgaaggcaattgaggccttctggcttgttcacaactaccattgttgtcgtactccctgtgaagatcgtcaataactttgcaaagatgaacagcaatagacattgtgtttttagtccacctacaattgccgtgttcatctgttataatgctgataatttcattcttcagccttttagttgagtatgtatgaataacatattcctttgtagctttatccattgaaggatcgttggccaccaattgttggaaaagtaaacggcaaactaaaatacaaacaatttgacgtatatcggcacgcaaaaggatcaatcttgcatgatcaaaagaaagcggagttgggtactctctcaccatcttcctacatgacaataggttaattatacttctaatgcaaatattgtagacatcagggatagtgatagaacttggatttctaacaaggccagcggtaacattttcgttgaattttttatcaaaccaaagtagggaagtatttaaattcacccttttagaggctataagagtgttgaaatactgtttctcaaattctacagcattacttaacagagctggccttagtattcttatttgatgattggcaatatccaatttcattgtttccaaaatttgaaaaaccaaccttaaaccttctattaaccttgttaaagaagagtctctttcagcttctttaaatttgttgctcattttatccacccatgggtccctcatgggggcacaatgatgtttaaataaatcagccaaccagcctgacaagttagacattatcagagaacctttcaatagttcttgaatgttcaattctgtgtccagtacattatttatcatcggagactctttttgtgggactatcgttaacaatacatcccttaaagtgtcaaaaagtgggactagtcttgacctgttatattggaatatttcaggcctcttagagtaaacataaatttcattttgaacatcattccaatagatattcgccaattgtctttttttattccctctttcgccatcaagatttggcctgaattgtagtagcgggtcgaatattatatcatgtcttagttgtgggtttttcagaatttcctgtaagtcaatctcttttaagccctgcaaatttataggaggaaatggaacaggcgttggagtagcctttatgtagtttattctatcttccaaagttaagtcaaagtttgagcttgataggaagctttgatttgtcattgaagtggcagtggaattattaatgttgtcattattagcgttagtgcttgcgttacctgatatttgttgatttaaaaaaattgcgcgctttaatgaaagagggtttgaactgagaggattattagaatgcaaatatggttgatgatggtttctagaaaattttttctttgatatgccggaaggagttggatgatttaaaagaatattttgattacgatagtattgattgtgggatgataattttcttaaagaagaatgcaaaatagtgggtacggaatgcgacctcatttttttatttgaaaagatccttaaaaagttagaagcatttcctggtggctgttgttgtgctgcttgttctttgtgtggttccgttgctggtggcaattgcggcgcggatgcagacggtggttgctttgacgacggtggtggggagggagatggattgttgatattagtataaatattctttgggggtatcgaatcaactttattgttcctccttatttcttcttcattatcatcgtttttcaagaattgaccagtcttggtgtcgaacgtcttgaatatagtattgtccctgtctatagggatcttcaaatcactactattagctgaattgccactgctatcgttgttagtggcgttagtgcttgcattcaaagacatggagggcgttattacgccggagctcctcgacagcagatctgatgactggtcaatatatttttgcattgaggctctgtttggaattatattttgagatgacccatctaatgtactggtatcaccagatttcatgtcgttttttaaagcggctgcttgagtcttagcaatagcgtcaccatctggtgaatcctttgaaggaaccactgacgaaggtttggacagtgacgaagaggatctttcctgctttgaattagtcgcgctgggagcagatgacgagttggtggagctgggggcaggattgctggccgtcgtgggtcctgaatgggtccttggctggtccatctctattctgaaaacggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttaaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggaaaatatacatcgcagggggttgacttttaccatttcaccgcaatggaatcaaacttgttgaagagaatgttcacaggcgcatacgctacaatgacccgattcttgctagccttttctcggtcttgcaaacaaccgccggcagcttagtatataaatacacatgtacatacctctctccgtatcctcgtaatcattttcttgtatttatcgtcttttcgctgtaaaaactttatcacacttatctcaaatacacttattaaccgcttttactattatcttctacgctgacagtaatatcaaacagtgacacatattaaacacagtggtttctttgcataaacaccatcagcctcaagtcgtcaagtaaagatttcgtgttcatgcagatagataacaatctatatgttgataattagcgttgcctcatcaatgcgagatccgtttaaccggaccctagtgcacttaccccacgttcggtccactgtgtgccgaacatgctccttcactattttaacatgtggaattcttgaaagaatgaaatcgccatgccaagccatcacacggtcttttatgcaattgattgaccgcctgcaacacataggcagtaaaatttttactgaaacgtatataatcatcataagcgacaagtgaggcaacacctttgttaccacattgacaaccccaggtattcatacttcctattagcggaatcaggagtgcaaaaagagaaaataaaagtaaaaaggtagggcaacacatagtatgaatacaaacgttccaatattcagttctccggtcagagatttaccaaggtctttcgaacaaaaacatttagcggttgtagatgcatttttccaaacataccatgtcaaacctgattttatcgctaggtctcctggcagagtaaatctgattggtgagcatatagattattgcgatttttcagttttgccattagccattgatgtggatatgctttgcgcagttaaaattttagacgaaaaaaatccatccattaccttaacaaatgcggaccctaaatttgctcagcgaaagtttgatctgcctttagatggttcctacatggccatagatccgtctgtgtcggaatggtcgaattactttaaatgcggactacatgtggcacattcatacttgaaaaaaattgctccggaaagatttaataatacacccttagtaggtgcgcagatcttttgccagagcgatattcctactggtggtggactctcatctgcatttacttgcgcggcagcactagccacaattagagccaatatgggaaaaaattttgatatttccaaaaaagacttgacccgcatcacagcggttgctgagcactatgttggagtcaataatggtggtatggatcaagcaacgtctgtttatggggaagaagatcatgctctatacgtagagtttaggccaaaactaaaggccacacctttcaagtttcctcaattgaaaaatcatgaaatcagtttcgtcatcgccaatactcttgtaaagtctaataaattcgaaactgctcctacaaattacaatttaagagtaatagaggtaacagttgctgccaacgccttggcgaccagatacagcgtggccttaccatctcacaaggacaattctaactcagaaagagggaatctaagagattttatggatgcttactacgccagatacgaaaaccaagcccaaccatggaatggagatatcggaactggtattgaacgtttactcaagatgctacaattggtagaagaatctttctcgaggaaaaagagcggattcactgtacatgaagcctctacggcgctaaactgttcacgtgaggagttcactagagattacctgacaacttttcccgtccgcttccaagtcttgaaactatatcaaagagctaaacacgtttactccgaatccttaagggtgcttaaggctttaaaaatgatgacaagtgccacttttcacacggacgaagatttctttacagattttggccgactaatgaatgagtcccaggcctcttgtgataaactttatgaatgttcgtgcatagaaaccaatcaaatatgctcgattgccctagcaaatggttctttcggctcccgtctcactggcgctggttggggcggttgcactatccaccttgttcctagtggcgctaatgggaacgtggaacaggtacgaaaagcactaatcgaaaaattctacaatgtaagatatccggatctcacagatgaagaactaaaagacgcaattatagtttcgaagcctgccttgggtacttgtttgtacgaacaataacactaaacaccttcttggaacaacctttaaatattaaaagtttactcatacctcttacactctataaagaaacaagttggtgagtccaatagaacccattccagcatccgatgcaaccatagcccggttgatgcgagtcagagtggctccgcacacagaggttatgtgaccatggtaaccgtacacatttttccacggcaaggaagtggcgcgaaagaagcaccgccctccacggatcaccccatttggaaaagaacggagacataaaaaaaaattaccttcacgccagactatgtatgactcgtagaaatctagcatccgcggagctattttaagtttccgcggatgcctttcgatcctttcccagtcgtctggttccgcgcacatatgactaaatgtccgcccatttccgtttaaatccgttttctattttctttaggtctttccattgtattccctgcaaccccgctgggtattggtattactaatagtgactacgcaacatcaacatataaaacaaatgatgagtagtgcccctccctcaccgctatcgcctcaccactttttatgcttgtatatgcttgtagataaataaatacctaacgaaaacaatatatacgaacctagtgtatttgtatcttttgtttttcaagttgaagtgttgcgaggtcaaaaaaaaaaaagctcactgtaggatataggagttactatatcaccagtgcattacattctcagtgcatccatcgtcttcaacattgattattttctccttccattgattagagttcaagctccctgagaaaacgaaggtatagcggacgtacccgcagagacataaaaaaagaaaaactatatcgaagaccgaaagcagtaaaaaagtggatagaataacacagctaccaaaatacgtaaagagaattcaatgagcaatatcaaaagcacgcaagatagctctcataatgctgtcgctagaagctcaagcgcttcttttgcagcttcagaagaatcatttacgggcataacccatgacaaagatgagcagagcgataccccggcggataaactaacaaaaatgctgacaggacctgcaagagacactgcgagccagattagtgccactgtgtctgaaatggcgccagatgtcgtatctaaagtggagtcatttgcagatgcactatcccgtcatacaacgagaagcggtgcctttaatatggattcagatagtgacgatgggttcgatgcccatgccatctttgaaagttttgtaagagacgctgatgagcaaggcatccatatccgcaaggctggtgttaccatagaggacgtaagcgctaaaggtgtggatgcgagtgccctagaaggtgctacctttggtaacattctttgtttaccgttgaccatctttaaaggtattaaggctaagaggcatcaaaagatgagacagatcataagcaatgtcaatgccctggcagaagcgggtgaaatgattttggttcttggaaggcctggtgctggttgttcctcctttttaaaagtaacagctggtgaaatagatcagtttgccggtggtgtttccggtgaagtagcatatgatggtattccccaagaagaaatgatgaaacgatataaagcagatgttatttacaatggtgagttggatgttcatttcccttatttaacagttaagcaaactttggatttcgctattgcctgcaaaacgcctgctctcagagtcaataacgtttccaaaaaggaatacattgcatccagaagagatttatatgcaaccattttcggtctaaggcatacctataataccaaagttggtaacgatttcgttagaggtgtatctggtggtgaacgtaagcgtgtttccattgccgaggctttggcagccaaaggttccatttactgttgggataatgccactagaggtttggatgcgtctacggccttagaatacgcaaaagccatccgtattatgacaaacttattgaaatcaaccgcttttgttacaatttatcaggcaagtgaaaacatttacgaaacatttgataaagtcactgtcctttattctggtaagcaaatttattttggtttgatccacgaggcaaaaccttatttcgcaaaaatgggttatttgtgtcctccaaggcaagcaacagctgaatttttaaccgcgttgactgatccaaatggattccatctgatcaagccaggttatgaaaataaagtaccaagaaccgctgaggaattcgaaacatattggttaaattctccagagtttgctcaaatgaaaaaagatatcgctgcttataaagagaaggtcaataccgaaaagactaaagaagtttatgacgaatcgatggctcaagagaaatccaaatatacgagaaagaagtcttattatacagtgtcatattgggaacaagttaaactgtgtacccaacgtgggttccaaagaatttacggtaacaagagttatacagtcatcaatgtctgctctgcaataattcaatcttttattactggatcattattttacaataccccttcatccacttccggtgctttttcaagaggtggtgtgttgtattttgcgctactatattattctttgatgggactggcgaatatttcttttgaacataggccaatcttacaaaagcacaagggctattctttgtatcatccttcagctgaggcaattggctccactctggcatctttccccttcagaatgattggtttgacctgtttctttatcattttattcttcctatctgggttgcacagaacagcgggatcattttttaccatctatttgttcttaaccatgtgttcagaggcgatcaatggtttatttgagatggtttcttcagtatgtgacactctttctcaagctaactctatctcgggtattctgatgatgtctatctcaatgtactctacctatatgatccaattgccttcgatgcatccatggtttaaatggatatcgtacgtactacctatcaggtacgccttcgagtcgatgttaaatgccgaatttcacggtaggcatatggattgtgctaacactctagtacccagtggaggagactatgataatttatccgatgactacaaagtatgtgcttttgttggttcgaaaccaggtcagtcttatgtgcttggtgatgactaccttaaaaatcaatttcagtacgtttataagcacacgtggagaaactttggtatcttgtggtgctttttactgggttatgttgttttgaaagtgatattcacagaatataagaggcctgtgaaaggtggtggtgatgctcttatcttcaagaaaggatcaaaaagatttatcgcacatgcagatgaagaatctccagacaatgtcaatgatatagatgccaaagagcaattctccagtgaaagtagcggcgcaaatgatgaagtatttgatgatttagaagccaaaggtgttttcatttggaaggacgtatgctttactattccatatgaaggcggtaagagaatgcttttggataatgtttcaggttattgtattccaggtaccatgacggccttgatgggagagtcaggtgctggtaaaacaactttgttaaatactcttgctcaaagaaatgtcggtatcattactggtgatatgcttgtcaatggacgtcccattgatgcgagtttcgaaaggcgtacaggttatgtacaacaacaggatatacatatcgcagagttaactgttagggaatcgttgcagttttctgctcgtatgcgtcgccctcagcatttgcctgattctgaaaaaatggattatgtggaaaaaatcatcagagttttgggaatggaagagtatgcggaagcccttgttggtgaggttggttgtggtttaaacgttgaacagagaaagaagctgtctattggtgttgaactagtcgccaaaccagacttattattattcctcgatgaacctacatcaggtttggattctcaatcttcatgggccattattcaattattaagaaagttatcaaaagctggccaatccattctttgtacgatccatcaaccttcagctactctgttcgaagagtttgatagattactacttttgaggaagggtggacaaactgtttatttcggagatattggtaagaactctgccaccattttgaactactttgaaaggaatggggcaagaaaatgtgattctagtgaaaatcctgctgaatatattttagaggctattggtgccggtgccacagcatccgtcaaagaagactggcacgaaaaatggttgaactctgtcgagtttgaacaaacaaaagaaaaagtacaggatttaataaatgatttatcgaaacaagaaactaaatccgaagttggagacaaaccttccaaatatgctacttcttatgcttaccagttcagatatgttttaatcagaacctctacttcattttggagaagtctgaattacatcatgtcaaagatgatgctaatgctggttggtggtctgtatattggtttcacatttttcaatgttggtaaaagttatgtcggcttacaaaatgcgatgttcgcggcatttatctctattatcttgtctgctcctgcaatgaaccaaatccaaggacgtgctattgcctccagagaactttttgaagttagggaatcccaatctaacatgtttcactggtcgctggtgttgatcactcagtacttgagcgaacttccctatcatttatttttttcgacaattttctttgtctcatcgtattttccattaagaatcttcttcgaagcgtcaagatctgcggtgtactttttgaattactgcattatgttccagttatactatgttggtcttggcttaatgatcctatatatgtcaccgaaccttccatccgctaatgttatcttaggtttgtgtctgtcatttatgctttctttctgtggtgttacacaacctgtctcattgatgcctggcttctggacattcatgtggaaggcttccccatacacatattttgttcagaatctggtcggaattatgctgcacaaaaaaccagtcgtatgcaaaaagaaagaactaaactacttcaacccaccaaacggctcaacgtgtggagagtacatgaaaccctttttggaaaaagctactggttacatcgaaaatcctgatgctacgtcagattgtgcatactgtatttacgaagttggagataattatttgacacatatcagctctaagtatagctacttgtggagaaattttggaatattttggatttacattttcttcaatatcattgctatggtttgtgtgtattacctcttccatgtaagacaatcttccttcctaagccccgtatctatactcaataaaattaaaaacataaggaaaaagaagcagtaatgtgggcttcagataacttaacattttgtgcattcatctgcctttaattcttaattctcattttacactatagaagaagacacgagtacatctcgtttcacttttatactgacattcatataattaacaataagtatagtttataatagatacaaaaaaaaagtcttgtattaccatgttaatagttacattgtgtataactctcgtagttttcaaaagtcaagtcttgttgagtaaaaaagtttattttacccttgggtttcgactcaaaatattggattacgatctaagcaaggtgttgcaagtacaagctaaacgaaaagaataagacaaaaaaactgaggctcctcaaactggtcaccaaaattgaacttcaaatttagtgtttctacattttttctattttgtttcatttttatatccctttcatatgattaacaaaacttggtaaattatctggcctgtcaacccttacctgtcctgtcccttctttagacaaaagaaaataaaaaaattggacacaggaaaacaacagcctccataccacagtttctgtgtcttattctatttaggaaggtcattctatattactcaaaggaaagacatccagtagaaacaatagtgttgctaaacggttaacttgcccactaatgtctgcttatatttgcaaatcactattgtggcaagtcataccctggagctttgtgattgaacaacatatactatattgcagcagtatttttcagaaataatattcgaaagaagtgagaacaagaaatgaccacgatagattacagctgaccaacttagaaaatgagtaaacttatttttgtcttaagaagtgcatgcagcgacctctcccaattaccaaattgtaattttttattattctttttttctgcatagttcattcgacagcttggttgaaaagagtgataaaaattttctgttttatgaaaagttttcataactctattaagggttgcactataagaacatttcgcaataaagcaacccttatccggaccctacatgttccgtaagtcctgccttatttatcgtaacggtattcatcttacaggaatttttgaatatagataacgttagttttgatagattggaacaaatgggaaaataacaatttagaagcgctttcctcagcgtatctgaattataaaacaactgcgcatattgctaagaactgcactgaaggcatgaattgtctattccgttagaaatataattatttacgaaagcatcgcgcagacgcaatttttttaacattttttttttttcaagtactctggaaaagttttcatgaagatcatgaatacgttacactactattattattgaaaataatatttctttcctatcagcaatcgcttacatattcatagtcatttactagggtatataccaataataatgtcccgtccacaagttactgttcactctttgactggtgaagctactgccaatgccttgccattgccagctgtcttctccgctcctatccgtcctgacattgtccacactgttttcacctctgtgaacaagaacaagagacaagcttacgctgtttctgaaaaggctggtcaccaaacctccgctgaatcctggggtaccggtcgtgccgtcgctcgtattccaagagttggtggtggtggtaccggtagatccggtcaaggtgccttcggtaacatgtgtcgtggtggtcgtatgtttgctccaactaagacctggagaaagtggaacgttaaggttaaccacaacgaaaagcgttacgccactgcttctgctattgctgctactgctgttgcttctttggtcttggccagaggtcacagagtcgaaaagattccagaaatcccattggttgtctccactgacttggaatctattcaaaagaccaaggaagctgttgctgctttgaaggctgttggtgctcactccgacttgttgaaggtcttgaagtccaagaaattgagagccggtaagggtaagtacagaaacagaagatggactcaaagaagaggtccattagttgtctacgctgaagacaacggtatcgtcaaggccttgagaaacgttccaggtgttgaaactgccaacgttgcttctttgaacttgttgcaattggctccaggtgctcacttgggtagattcgttatctggaccgaagctgctttcaccaagttggaccaagtctggggttccgaaaccgttgcctcctccaaggtcggttacactttgccatcccacatcatctccacttctgatgtcaccagaattatcaactcttctgaaatccaatctgctatcagaccagctggccaagctactcaaaagcgtactcacgttttgaagaagaacccattgaagaacaagcaagttttgttgagattgaacccttacgccaaggtctttgctgctgaaaagctaggttccaagaaggctgaaaagactggtaccaagccagctgctgttttcgccgaaaccttgaagcatgactagaatttatagtatagatctttaactttaatttaaatatctttgttactagtctttaatcaaacctttttgttttctttaaagtcgaaacgtcagatttgctcaaaaccttcttgtcgttacaacgcgaaaattgtaatttaaaataactaacgaagaaagctgaaaaatagatgtgagggaaaatcgtttataaacggccatgctcacagagaatcatgtatggagatttaggtaataaattagtattagaagctaaaagaacaaaacagctgtacgcaagaagtaatcaagatgttaatttacccatgtatcatgaagatataatacgaaatattctgaaagaagtttcaaatttacgtaaaaatacggaatatcttaaagaacagcagcaactaggaatgctagatgataaggtggctaaatgccagtatttcgttaccttgttatgtatggaaaggaacaagagatgtctcttagcataccaaaggttgagaacagacatactagattctatggcttggaataataatggtctggacttgatgagtagcattacgtttagccaacaagacacaaataacctttctcatcaagagcaggaatatttgaaagaatactgcgatttaattactgatttaaaaagtggtgacttggtcgatattgatttatccggctctttagtgcctccgagcgatgtatttattgatgttagagtgctcaaagatgctggtgagattcaaactgaatacggcgtgtttaaccttattaaagactcccagtttttcgtaaggcagtctgatgtagagcgtttgattcaacaaggttatttgcagaagatatgataaaatgctttcaagctggtcttcatgatatataatcctttataaagcaagatacatacctccattctaatttactcccttctatgtttacttcagccctttttaatagatttcgtaagttttggttgaggaggctttctgagctttacgcgactttattgatgacgaagcttcactttattataataatgaaaaactgcgcagagaaactatcgcaaaacgaaaccatcttcttaccctaaagcatcctgtttctgaaaaaatgagagcatatggaaagaggggcccagttctcagaactccttttagatctaataaaggcttgccatcttcttccgatgttgaatttagtgatgacgatgtaaactccgtgattcctgatgtaagttctaccatttcgagcagtattgcagaccacccgatagagggattattggacgagcctagaaaggctcaggacagctcgtcgtcatttgatggtgcaaatgagaagccctcttcacaactggactcaaaaaggaatgaccaaaacgtcaaaattatcactagcagtgatacctcaatggcatttatgaaagatgaaaagttaagtgcctttaatttccttgatggttcaaaggcatctaagagaaaaagaagaagaacttaccaaaagcatgatgcgaacataacgtcttcaattgaaccagacgtacaagatgaagacagcattacaatgcacaatgaatttgaatcaataaggaaaatatacaatgacatcaatgaattcatattgaagctaccgagagctgacgatgatatactgaataaaatgcttgaaaatgagatgaagatggacgactctatagagaataatagcatacgcacatccaaagacaaaaaatatggcaaatttagaacaatattaataaacaaaaataaagaaaatgaaataatgggagaagaggtagatcagaaagctaacaccttgtccctaaataacgctgacaacagtaatgctgaaaaagaaggattaacttcaacaaatcactacaacgaattaaaaaatatgggagatacaataaaataccaggatgatattgagtttcttctgtccaattctaaaagtaatgacaatactacggtaccaatcaatgaatactttaaaaaacttttaaatttatccctaatgattattaatgacgaagaattttttcaatatgcgaaaagatatttcaaaaaggaaataattaagcttagttttgcgcaatttagatcggattttcctgaattaatcttattacagggttatttactacataaagttagtgaatcacaatccgatttcccgccaagctttgacaatttctctatcgaattaagtaaagatgatggtaaaatacggacaaaaaagaataagcatattaaaaaactctcacacctaaatttcgaagactttcttcggaagactcaattcaaaacgggactttattattcattatcactctgggaaatgcatggtaatttatcgttagatataatcaagagaatctccatccttgcttcaaataaggacttattcagtcggcacgttaagacttttattcctcttttagaaaaattaataaccgcttccgaattttgccacatgtatattgaacaacctgaaatgttcgattcactgataagcaacttgaataatcagtttaaggatatgcttgatgatgactcgttgattaaaatcctaatcttgttaacaaacatggaagtacataactatacgctatggaaagaggcagatatgatatttcaaagttcaatgaacacaattttggaaagcatacatccattgacagacgcgaaagttgataacatactcttgcatttagggctctgcctcaatatttgcagtagagaaaatagtcgtttaaaacttgacggcaaattatggtatgatatgaaaactatatttgttaaaatgatccgtgacggttctgacactgaaaataggttagtacagggcctgttttacttaaatttttcatttttaattaaacaacggaaagaaaatagtaatttagacccaggggagctcaatttgttactagtagagctggaagcatttaaatcggaaacatctcaatttaatgaaggtatttcaaataaaatcgaaatagcgttaaattacctaaaatcaatatacacgagtgaaagaattacaatataaagaaagcatacattgaacatagcctggcttcatcttcaccctgctggcaactattgaaaaattgtccagaatttattatgttatccttaaattaatgaatgccatgcacttgcttaaattttgacatcgctttcagtgcattgaagctaccaggatctttgatgagccttctagcgtatttttttgtatgccttatggcgcttttaatatgttcatctacaatttctttaaaatgtcaatggtagcttactttttaagagttatactcctgacaattttttttcacgacataagtttggtggaaaataaatgcagtattatttaattatttaattaatttccttgactgcacaattcatcaggagcgttatacaaataaaagaaatcatactgtttcatattaaacacgaataagaaattcaggttgaattacttggtgtgattatttatcatacgcataatatcaaaataactaatcataaaaaaatatgagcaggatctccgcaccttttaaaaaaggttgaaagggcttaaaaaactgaaagactaaaacctttttttcgaggcataggaagcctagagtacttcgggtagacgatataacaatgcaataaaaatagtatattaataaacatacgaaaaaaggttaatatattcattaataatgtactgatggtaattaatataccgcagagtcttgaaactcggcgggtaaaaattctatatcccataaggtccatcaggtgactttttgtgatactgtgttattgttactttaaattggttaattattcaatcaatttccagtgatacagtagaaaacaaagtcaaagaatcgcagtacccgctggtcacgccaaaaaaataaagcttaatgttcttttagtcaacatattcactcaaagattgcatgatcaccatcagaatgtgtgagtaggttaggctgaacggcagtaggagcaattacgtatgttagtaaatggaaggagaccagcattatggtttatcttatttggtcttccgtacacaaatagtagtgaatgtatggtaaacatgcatgcgatgacttaactaaggatttactggtgttggatcaaatttaatctctgcatgtataggctattcaataatcatgaggcgttaaaggatagtttacttatcatttttccttcttgaagcattttcccagagctgatagatatattgaagtagtacttatatacctttcaactgatgcatgtgaatgcctgcttggaacatcgggaataagaattatagtaacaataccaatttctccagcggatttgtctattttcttggtacttcatgcaaggtgcatcctttttctcttgaaattcattctgaatggccataactgccaatgttcaccattcctaaagacgacgtgtttatcactcctagttgcttggaagttagacaacatgaggaataataacctcaagagattaaaaaatgcaagtaactatattacatatttattatgcacactttgccttgccacttgtgtaatagacctgggttcttgccgaggtgatatgctctttaataaaagatcacctcaattcaagactaaaaatggcgaggtataaatctgcgtcgctaacatgtacaatattttaatgtatactctcgcatatttatattttcgtttttcacggctttaattagcgtacgtggtttctgatttttgcttgagtaatgcactatttattaagatagccgcccaggttaaattcttgaattacaactacatgtcagagacgaacgaaagagagaaatcaagacgatgcaacaaagatcaaataggagaagctgctcctatataccactcggggtacataataatgccgaaaagagcttgtgcaccgaagttgctccagcaagaaagaacaaaaggtctattacgacttctcccatagtcaacatcaacgttgtagaaagaagactgtttaatttggaattggaaaaacaacaacttcgtgccaaaaatctgtctgagaacacaggtggcggaagcccaatgggggtgcttatctggacgccaaaaaaggagtaagagaacaagatcaataccaaggaggtccctcgaaagagcttgacaggctacaaccaccaccttcaatgaagaaaagccctccaaggaagaagaagagcctaaaggacttgatatatgaaacgaacaagacattctatcaggtggattctaacaaggttaaatataaggtaggtctatccaagaaacagctattaccatccaaaacggtagacaactaagttcaaagaggagaacgtttgaaaaagagttcggtggccctccacttttttcaacgtgcaaaagttgtccacaacttacttatcattaggctaaaattacaatttatatcttacgtatcctttatctaatttgcgactgtaaacataaatttaggataatattaggagagacagagggaaccgcaactttacttcgttttcgattgagataaagtaggttgctcgtcgatgggcgcttcgtctgataaactttccaacccatcataaagtgttttccacaaatcagaaactgactggaattctcttcccacagctatcgagctctccaatgatatattgagaccattcagaccattcaagattgaattcatagtctcattgatctcctgcaatactatattcctctgctcgatgaagtatttgtcagtggttgatatcaacttttcttcatcattggatgtactagccatcatatgtacatatatcctcacacgtccgagctcttcatcagtcctattcctacgctaattactacctcctcttgttaaaggtgactgtttattccctttgttattttcgcggccttgacttttacccggaggtggccctttccgctcaatggttctagtgatcgcctataaccgtgtagtcatattcatacacgtacaaattcgtttgtcttttcatatatatagttatatatgctatgctcgtttgtgtatttattggattatgcaatcaaaataatgatagttacgaatagataaatgcatttacggactgaaataagcgcagctaaaagaatattcattagttctatcctttcttttcaatcactaacttgagcatcgtcattgtatcttggttcagcgtcgaaaataagctcgtattttctccatttttgtcttagtttactatttggatcattatacatttcttcgtcttctttgtcaaattcatctaaccaatcccacttactgttgaagttgattttcgaaccggtggcggaggtgaaactattcgaatctgcttcttcgctaatcatatcattcatctctacttcatcgaaaattaacggcatatcagaagtcagataattccagattaataacagataaaacctcaagctcttcacacctcgtaagaaccctttatcttctatatttggcgattttgggggtatacgaaatttatccatacattccattgcatcttctttagtaacacaacgtgcaaaatcgatcaagttgactttaacattagcagcttttttccttttagaatttgatttattagcatctccatcgtacattagtaataaagacgcgccatatagcctgtaacctttcaaattaaaaatttcagaatacaaagtatctagttgcttgatcaaccttggaatttgcctgattaaactttcaatggtcttaccatcatacaaaaaacgtgcaagtaccctagcaaattgccaaccaaccttaacccttctaccaaagtatttatctcttgtgatataataatctttgttccaaacctttaatccgcagattctaacgcctaaacgcctagaagtggtctttaaacactttgcacgctgtgacagttgcttggctcttttggcgtctacgccatattgtcttgtccccatctttagatccagtgcacaaggcttgttcatgtttcttgtcaaatcttccaataagataaattttgaaacaatggtgtgggacgtctcctcaaacgtaattgattcaatatcatgatgactatagtcatttgaaacattatacgccaatgactttataatcatgtttttaccagagtcaagatggcagccgtggttatccatatttatagtttcgtttcccgtatcttcatccatatcaaaaacaccatcttgtgcgttgctgatataattcggggaggtggcaaattcgccatcatctctagaattggttgcagtgagaatgggtgataaagagttgcagaaagagtttttatgttttatttgttcgtttttgtggaattgcttcaaatccattactgaatgcgagccatctaaagcattagatattttttcatgaagcgattttttcaagaaaggatcctgcaaattcggattgactttcgagtcatccatctgtaaactcgcttgtgacgatgaatcaccaagagtcttcatagacgtattcgatgcatcatgggacgaggctcttgatttttgtgttaaaaaagatggactggaacccaaacgcgcattatggtttcccattgtagtcgtattagagtttcttttccttctaaaacatttcggtgcaaatacttcccttatgactaggttcttcaattcagtattgatcatggtggacccagaatcgcgtctttttaatttatttgtattgccacgctcaccgaacgaacatgagttatgagaagaggaggacgaaaagtacgaatcattcggtgccgagtttggagaatcggaatatttgtaccacagagattccggtataatatgcctgttatcatttaatacaacctcgggcaacaaggaaggttggttggaacttgacagtgatcttttcacgtgtggatggacagactcaatttcaggatgctctttttcaagtacttgtctcgacgaatgttccaaggggaaggaatgtatgtgtgttaagggggtccccgtgggttctgtattaagcgcaatatcgtcgttattgttatgattgacttctatgtctttgttttcattactggtatcatttttaccgttgttttcttgatccaaatcgcttaaaaagtcatcttttgactgaaaatgttgcctaacattcaggacaccaatataacgtggcatgaattgcaataattctttatggcacagctctatattctcataccacctgttttctctattcactagagccttacaaaccgctctcttcgaaaatctgaatattgcagtgtgacctccaactctattcgtaaatggttttagttcaactgctaggggatattccctatgttcattatcaccttcatcctcttcttcgtccgcttgctcgccttctttatcttgttcaaacgtattgggtttttctttaattgattcgctatgtggcacaaactgttgaggttttttttcgttactacgattgttgacgttttcttgccttagggattgtgataaagttgaatatgtcttaactttgaaagtatgtcggttatatgaactaggaagtgtcgctataccagaggcacaatttatggtggcaggctgaatagtatcaatatcattttccattttatccttttcttcataaccagaatctgctttacttttgtgaggatagtatgttgcagaagaaacaggctttaacgttaagtcctccgatattccatgtaagctctcctgataagtggacttaggcgaaatacatccctcatcaacattctgaattggctttaaagaagtctggtggtgtaacacctgtggttggtgtgattgttgttttgcgatatcctcaccagagccttgacctgtctcagtaatattatttctatgcgccacgtgtttattgggcttaattgccggctcctcgtggttagataaaatgaaacttgacaatgaagaggacaaagtatctgggttattctttttttcagaaacttgtagtccttctggtaccgatttgggagttgcttctgaccttgttattttgtccgcgcatgtcacggacccgccattattgctatctacaccattgttgttatcggctaaacattcatcatctctaaaaattcttaaatatgtactcgcctttctgccatgtaagacggaggaaagtttcttcgtctcaggtacattaagatctttcaatgttgttatgcacccttccgactctttttggcgcaaatgctgctgctgctctcttaatgtatcgggtattttatcatgaatttcgtgagaggtatccatagtcttttagctttagttttatatatacaaaaaataaaaaaaagatttgagaagacagaaagatgtacaaaatgaaagaaagaagacaaaagacaattctaatataataaggtcaaactgggattttcccttttgttggagatataatccaaccaacagagacaaacaagaacagaaaagtgtttttcgtcttgatcctgtattgaaaaaaaaaaaaaaaagcgatacggcgcgaagttgaggggccggcgacacttctgcgatgagttcgaaagaagtgttaataatttttatgaaagcaactattacttatatatttgtaactttaccgttgtggatggctaagctaagtggaaataatatatgaaatacaggtttaattatgtttggtttaaggttaaatcaatgattttttttcatcacaaatacaagaataagaaaagcgaagaacccgtaatatgaaaggatacggggtgtcaatgtttcgtgctgaaatccagtcgtttgtgtcgtaacaacgatggattggttgtcatttttagcattacttttaaattggcctgtgttgtagtagtcttctagcagttgatctttttctttccacacgcccagtaaccaattgaaaaaaacttcgtcatcttgcaaagggatctcattaactctaaattccctaatataaaaatctactttctccggatagacacccattaagaatattttcttcaaggtgaatttggtgccgacgtattccgttctcaaggcgggagaatatccaatagtgacatcgtagatagcatctaaactaggagctagtttttctactgcaaacttcaagcctttagagtgcggtaataacaaatgtcttaattggacatggtccaaatgtgctctttgacagaatgcctcgcttttttctcttgtcttgaggcttagatttgtaccctcagggaacatgattaaattataagcggcaatggattcatttgtcttggaataacaactcttataatttgtaaggggccccttgcacctcgcgtttaagtccatagaaaccaaactatttgttaaagctttctcatccttttgccagttcctacttaaaaatataaacttaaaatttcgcatgccaaatcccagtaatggtatgtactgcagagctttcttcaggatgatataaacgttaccacccaaatttgaaacaaaggaaagccaccagagataaatccagtctgcatacatttgatgatttgcaattattatagccctgtctttaaatctaaagcatggcttggcgttagaagagttcttcaatggccgcgatgtttcaaaagtgacattcaaagaagagggagccaccatgttcaagatcatgcataataaaacgataaaagccttcttactttgatttataccattttgaaatctaatcttgctccaagggagaagcacctgtagacagatctgaaaaacgacaatactcagcgagcctgaaatgaacaagcaagcgataagcagcctttgcaacccttttataaagggattaccagtcttttcataaattccatacctacggtatttttgggaatgcttcatccttcttaaactgcaaaacacagtcgtacgtagggttgtttgttcatttctttaaccttcgacggacagatctggggtacgttctaataaaagtaaccgcgcagcctatctccacgcgaaggggtaaaagatcaaacaagtccttaagaatatacaaaaagctacataaatataaaaaaataaaggaattgagcgtaagcatctttgtatttgtctttactagatcaaaatagcaaattatttttttactctttttcttttcttaataaacgcattatcaactgaatattatttcgctcagtttactgcttgtagtaatgtgtgggcacaagaggcattttagcaagttcaatcgggtagaacttgttccttacttgaacaagcaacttcgttcccttcttgtggtaacctttctgtacataagcttgtccaatattgatgttgtttaaagttggagatgcactacctgatgtaacaaggccgacctctgtttcggcatcgggcaagaagatcttgacaccatttctggcagctggcccctttttcaagtatttgaatccgactcgtaccttgctatacgttttattgtttagctggtccattatcttggcatagccattgaaccagtacttttgatctactaggtcccttcttgactttgaaatcacccagtttaacgcagcttctactggtgtgatactttcgtccaattcatgaccatacaaacacataccagcttccaaccttaaactgtctctagcagccagtccgataggcttcattactggattggccaagagttgctccgcaaactcaaccgctttctcatttgcaatgcttatctcaaatccatcttcaccagtgtacccgcctctagcaatttgaaccaaagaaccgtcctttaacgcaaattcatgtctttgtccaaaaaataactcttttagatcctttccaggagctgtttttgataaaagtggttccaacacatcttttgctttaggaccctgcaatgccaatagtgatctaccttcaatgattttccattgacaatctaaagtagaaccattttgtagctcatcgtgaaagaactcggtgtctctttccgcacagccagcattggtcacaatatagaactcattgtcatcgttttctttagtgatgatggtatcgtctaccacgcctccctgtggatttaatagaacacttaaggtccctgacccaacaggcaaggcattgaaatctgtgggcgttacacgttgcagaaacttaacagaatgaggaccagataacttactttgtaacatatgagaaacatcaaataaaccagcgtttgtcctggtccaattatgtgattcaatatgagtctgtcccttgtatagtacgggcatggaatatcctgcgtatggtaccattgtaccgcctaatgacacatgaaggtcatgaagagcagtttttttcaaagttgagttgaatctcttaaacacaatttttttgattatagacattattgcttgtgccaggcaaagctctttctacatatgtgagctacgggtactgtaattggatttgtttgggttcaaggtgctatatatatgatatttggacctattctttttgacataccgtttactcgaggcaacacgagtcagggctcctgagcagagtcgccctgccgaaagaagtcacggcgatgaacaaaataggtgatatctatgaccagctctaagtaagaactcagcttcccgtgagcatggttctaatggagtaaaagcgcccatcgagatccaagaatgcaaaaaaaaaatcaataagcttgtgtgggtaaatacggatgttagtcgcatcgagccgattaaaagtggcgcagatatagaaggcaaggacctcatgacagatcgtaatatctatctttctccaagtccattgtttcagcttcgaaatcccataaacgtgggcgtattttgttgttcgtattgttgccttctatttggcttttggtatcttcgattgctttaactataccgtccacgaggactgcgcgccctagattttcatttgtagaaggaatgatcaaatctgcaaaagttctagtgggctctatatattgttgcatctccgggcgcagatggtccatatactcagtgatcaactgggctagttgttcattgctccctacgttcttcttcttgattagactaattaatcttttatctgcatcactatccaagaatacttttaattgagatatttcgttgatgcgtttatcgtatagcgcataacagccacatactattatcaaatctatcgggtcctcgtaatcatgttgaatcatgtcattttgagaagttacagcgtgcttttcatataccaaattaaggatattatcaaaatcatagtcgttattattgtagctcttgatgttcccttctatcatattatctaggtttattacccttatattgatagagttatataggcttttgaaagtattttgtaaatccagtgcaattgctccaacaccagtagcatgccctccaccgatagaaataacaattcttttttcttcgacagcttttctgtccatttcctgtaatatttatctcgctaattgttaatgcaggaaacgaaaattaaaaacgatttcccttgtggtatgctctaggaaaaatgtacagataaattgaattatccgtgatggcagcgtacaatccatagttgcttactatttgatctgctttttctatcagtgtcgagaatttatgccgaagtttgaaaattttattttatgcgatgagctagataatagcagggcccagacaaaataaaaacatgaattatacacaaattttaatataaaagggccaccactccttcaagaggtataaaaatttgttcactcaaataaaatagaccgtacagaaacaaaaaaaaaactcattagacatgtcgtttgacagagaagaagaccaaaaattgaagtttaaaacatcgaaaaaattaaaggtgtcttctacttttgaaagcatgaatctaaaagatgacttacttcgaggaatatactcatacggttttgaagcaccatcctctatccaatcaagggctattacacagattatttcgggcaaggacgttatagcacaagcacaatcaggtacaggtaagacagcaacttttacaatcggccttttacaagctattgatttaaggaagaaagatttacaagctctaatactatctccaacacgtgaattagcaagccaaattgggcaagtagtaaaaaatctaggggattatatgaatgtcaatgcatttgccattacaggtggtaaaactttgaaagacgacctgaagaaaatgcaaaagcatggttgccaggccgttagcggaacaccaggaagagtattagacatgattaagaaacaaatgttgcaaacaagaaatgttcaaatgttagttttagatgaggctgatgaattattgagtgagacactaggtttcaagcaacaaatatacgatatttttgcaaaattgcctaaaaattgccaagttgttgttgtcagcgcaacaatgaataaggacattttagaagtaaccagaaaatttatgaatgatccagttaaaatcctagtgaagagggatgaaatatcacttgaaggtatcaaacaatatgtcgttaatgttgacaaagaagagtggaaattcgatactctgtgtgatatatacgattctttgaccattacacaatgtgtgatattctgtaacaccaagaaaaaagtagattggttatctcagcggctaatccaatcaaactttgctgtagtctccatgcatggtgatatgaaacaagaagaaagagataaagtaatgaatgattttagaacaggtcattctcgtgtactgatatcgacggatgtttgggcgcgcggtattgatgtccaacaagtttctttagtcattaactatgacctaccagaaataatagaaaattacatccatcgtatcggtagaagtggtcgatttggtagaaagggtgtggctataaacttcattaccaaagctgatttagcaaaacttagagaaattgaaaaattctattctatcaaaataaatccgatgccagcaaattttgcagaattatcataaaatatagagaacatatacctacataaacaagttaagagagtctcatccatgcggcttcatttttgctttcatacggaattggagagcatttgtaattgttcattttgtgtgacgtagagtttaattaagtcattcaaactcaaatcgcgaagaaaaggagacagatcgcaaaattgtgaaattacatcgagctcaatgtccgagtccactctgaatctatcactgtcaacgctaagttcttcctcttcatcattagatttatcatcaccatgtgatgataatgttctcatttggttttcctccaagctgagactatttgtcctatgtgacaaaagctcatattggtcgctgattagtgtgatatcctcaagagatcccgattcatccaattggacaattatgacattttcaagttcatctccgaccttatctattcctgctgtcaaagcagcatcacttgaatctactagttcatcattgttgtcctcaaatatgtacttaatgttagtgggaaacattgcataatcacttccgtccgtgctctttgattcattattgtatgctggttgatcatcgttgctgggacccttgttatttttgatattctcttctaatctgtacttgacatttttatcataaacagtaactgtaacattcattcctgttcgcagatttcagcaatgtttaccggcttaataagaaaatgggaatgcgacgtttatcttggatattgaccacccttatattatggatatgtacttcaaattattatcttttacgataaaaaagattctgatccaaccgaggttcgaactcgggatcttcgccgtgtaaaggcgacgtcttgaaccactggaccattggaccggaaacccattggaaatgacttaatcccaatatcgctatattaaatgtaaaataactttttcaggataatccacaagagtggtgcttctgtcattaaactaatttttttaaggcctgttcgcctattatatgtcgaaagtgtgtatttctttcaagttatgcctgcaattcaaaggacagatttattttacagtgtcgacgacaccgtttgaaaatgcagatgcaggactgggcacgttttacaatacgtatcgagtcaaaaatacactgattttggtgatattagctgcagcatggcgaatttttcacatattactgataaggatggacattatgtttgacttttttccttagagtaagtatggtcagcagaacaaaaaagagttcctacatttatacgaaggtaaaattgtaaaaaacatgaatgcggcctatccggctcgaaaattgttcctcatatatattaaaaaaaaatcacgtggtgcaaaaaaaaatttttttgtcatttcttcgaatcaactcaatgaaatttgaaaaatagcagaaaataagttgataagatcgcaatgtaatatatatatatatatatatatattacaattcgtgaactggcacaaggaaaagcgtgtaattaaaaatgttggacatcaaccaatttatcgaagataagggtggtaacccagagctaatcagacaatctcagaaagcaagaaatgccagtgttgaaatcgtcgatgaaattatttccgactacaaagattgggtcaaaacaagattcgaattagatgaattgaacaagaaattcaacaagcttcaaaaggatattggtttgaagtttaaaaacaaggaagacgcttccggattattagccgaaaaagagaagttaacccaacaaaagaaggaattgactgaaaaggagcaacaggaagataaggacttgaagaaaaaagtttttcaagtaggaaatatcgttcatccatctgttgttgtttccaacgatgaagaaaacaatgaattggtccgtacttggaaaccagaggatttagaagcggttggccccattgcttctgtgactggtaaaccagctagtttatcccatcatgaaatcttgctaagattagatggatatgatccagaccgtggtgtaaagatttgtggtcatagaggttatttcttcagaaattatggtgttttcttgaaccaagctttgattaactatggtttacagttcttagctgccaagggttatattcctttacaagctccagtcatgatgaataaagaacttatgtcaaaaactgctcaactatctgaattcgatgaagagttatacaaagttatcgatggtgaagatgaaaaatacctaattgctacctcagaacaacctatctccgcttaccacagcggtgaatggtttgaaaagccacaagagcaattgccaattcactatgtcggttactcctcttgtttccgtagagaagccggttctcacggtaaggatgcttggggtgtcttcagagttcatgctttcgaaaaaattgaacaattcgtcatcactgaacctgaaaaatcttgggaggagtttgaaaagatgatctcttactctgaggaattttataagtctttgaaattaccataccgtatcgttggtatcgtttccggtgaattaaacaatgctgccgctaaaaagtacgatttagaagcctggttcccataccaaaaggagtacaaagaactcgtctcttgctccaattgtactgattatcagtcaagaaacttagaaattagatgcggtataaagaaaatgggcgacagagaaaagaaatacgtacactgtttgaattccactttggctgctacccaaagagctttgtgctgtatcttggagaactaccaaacggaagatggtttggttgtaccagaagttttgaggaaatacattccaggtgaaccagaatttttaccattcgttaatgaattaccaaagaattccacctctagtaaagacaagaaaaagaagaattaaatatagcatatcatgaatgtcacatatatgttgtttctgttctgccaatcttttttaatatatttctcatgatagctccataatcttatatacatggttgcataataaaataaataaataatgagcctttaccaatcgatagtgttcatcgcacgtaatgttgttaattcaataacgagaatattgcatgaccatccgacaaatagttccctcataacccagacctattttattacacccaatcattcaggaaaaaacatttcttttcatctttttcacgatttcaaatattgttccgcggatacgcgacactattcccagctaataatattcccggtgaaagaaaattccaggccaacccaagtaagtcgtccgctgggtggacgcccccacgagtcagtgtttctgcctaagtttacgcggacccaaaattcatactgtctcactcgcttggaccggatgggctttcctcctcctaggaaggcttccacaattatgcactttttccaagatgataggactgtaatgtgcagtccaaaagatggtatacctgtatcatcatttcatataatgatttgctttttggaacgtcgaaaaggaaattaagcaaccagcaagatgtccactgaattaaccgttcaatccgagagagctttccaaaaggtatgaatttagcgataatgtctcaagggatttaaagaaattttacctaaagtaactttgctgatatatatcgtctgaggaattgtttagaatagatgaaaacttagcaggtatcctattgaattcttagcatgtttattgttacgactaatagaatttgccagtcaaaatttacaatatttgcgttaattaactacaaaaccggcggtgccgaaggcttgataaaggtagcacatttttatactgattcattacgtttacgatagttgattgggtaaaatttctttttatttcacttatgcgaataacttactaacctttgtatcatcctttttttagcaaccacacatcttcaacaacccaaaggttaagacttccaagagaaccaagagatggtacaagaatgccggtttgggattcaagaccccaaaaaccgctattgaaggttcctacattgacaagaaatgtccattcactggtttagtttccatccgtggtaagatcttgaccggtaccgtcgtctccaccaagatgcaccgtaccattgtcatcagaagggcttacttgcattacattccaaagtacaacagatacgaaaagagacacaagaacgttccagttcacgtttccccagctttccgtgtccaagttggtgacatcgttaccgtcggccaatgtagaccaatctccaagactgttagattcaacgttgtcaaggtctctgctgctgctggtaaggctaacaaacaatttgctaaattttaagctggttatgaatcagcataagacttacgtaactgtttattttataattatttgtataatgtactaaaaatataaattcaataatctccacttctgcaagaagcaaatgtactatgaagtgaatatttcaccttgtaatgatgggtggatttgcattcttctttacctttaaaaatcagtaaatatgcttttatctattgggtctgtatatgtttgggaaagtaacccttcttaattgatttgttccaacaatgaatcaattatttcagctgttgaccttcctttaaagtcatgaatcttttctctcatctgctcgtaacataatctcagttcaagaccagttcgaggatatccgggcttgtaggtagctatactgttccagtcgatatttgaataggacgttttaggtagctgtttcaatcgttctagcagccacttcctttcagaaacaggaatgctcaacatacttctggctgcttcatctgttactaatttattccacttatagcggcactgtatacgggatctagttccgctcatgcgttcactgacgacagtccaattgatcatatctttgaaggtaggattatcgctaattctctttccctttggacccctagaatacatttgattgtatctatcatttttgttggcagcctccaatgccttcatcctttgatattggtgtgcctcttcaatcatttcatttactacagtagtcaacaattcttcttcttctttcgaccatcttttagaacctcgctttgaaccacacttcatatagtttctccaacggtccctacaatcttcaggcattctgcctaacaatttgcctacttcggtccaatgaccctctttttctaaacataatcttgccaattcttgatcttcctctggcgtccacttcccacgctgttcgaaaatatgatattttcttcttatatgtttatatattgaggaccttgttctataaggtaaaactttgctgatatttgcccaaaacccatctctaatgactccgtctgtagaccaaattctctcgcacatttggcgtctatccaagcctcttattttcatgtattcttcgatgaattggtccaaagcattttcctcgctgggagtgaacttcttaccgatggattttgtgatagcaccgtcaattactgacgctttcacaatatcggatcgcagtaatgcggtatctccattgttttcttctggtgccaatatcaagtcgtctgatttcacatccttttctggtatctttggagtgcgctttatgtagctgccgtcatttggtatcccctctaaatcggtataaattctaaccagcgtgctgctattgttattaaagttgttttctttatcatcctcattaacttctaacgatttacttggatgtttagctaggtatgccttttcagtatcaacatacttatcaaaagctgtttcagcaatgagatcatcaggtaaaaatgctgttgtcgttatgccatcgtccagtgtagtcagctgcggatctaggaccatttttattttggcttttctttctttagagctttttcttttacggtgcttcttcctctctgatctactattagaagattttttatgacagctcctcttatctttttctctcattgagctgttgtatgcggcagcaacagctgctacagcaacagaatttggttcgatatcatccactttacgtaaatcttttgaacccgatgttttcaaataccaatccatatcagtgtcttcatcttcatgagacatttttgaaccatgctttctcttcttctgtttcttcaatttcttctttgtctttttaatatgattcttcaagtcgactcccacataccttagcactgcttcttctacagattcttttgggtcattattgttctgaaaatttgtgctcttaaggtttgacacgctgtccattctacctttatctttcttcttgacgcagacaagaaacggctgcttgctctatgcacaaaatttgttcagcgccaactgtgtcgtgaacgatgctatgttggaaattacaggagatgagttgtaaagcaactgacgagatacttgaagtacattttcatagctgctggaaaaagtcctttcctatcgcatttggaaagctctgacctcgctcgatcttcattgtttgatcatttcttcaccgctcatgtttggaaaaataatacgtagataatgttctaaaaaaaaagcggaatttcttagagaatataacatcgatgattcattagtttaaaaagtaaataatggtacatagcttgaaatctaatttttctttatcatgtttatacaggcggaggtggggcattggccatgtatattttattcgatgaggcctggaattgccccaacagggttgtataatgactcgcatcgaatggctcaaaatccctgttagagttggaaagcctttgataaaatctctgaacaataatcacaaattctgcgagacagtccaatgactctcccatgatagataagtttctacccgtttttaaaagtgagtttccaggttgtgtgacagatgccatggcgctactgttgtagtattgtagtgcgtcatagcacaacttctcgaaatttgataagtatatcgagggaaggtttatggaaagaaccattagctccttaataacctcaatggtagcgagcagagaactactggccacaaaagttttatcgccaacaacaaccgatttcctatgaccttgatatgtttcatttccttcatctttttccttgtcctcgcttctgccattttcgcaatcatgagaaccccctaccatgtctaaaatagttgtccaactcaatgggtctatgtctatacttgacacaatgtcgttaacatcgctctgaatagaggagtccacaatatatggaatccattcttcagcatcaatctttttctttatgttgcggtaattttttgaactttgtgcgtttgcataatgcttgatctgagatgctaaaacattacttaaatatttcgttaaaaattcaccacttaatacttcacattcttgaataaaaataacgcatatagcataaaatttcaagaaataatcataccgtagagataagttcaattctcttcttacggcaatgatcttgcctgtacgtaactgaataattctgattatttcgttgatgccagtacgtatatccaattgcgtaatcatgttgtgctggttttcgtttggacttttaacagatgctagctcgttaagagagatatctagaagcaacttttgatgcccataaagtcttcgaagagcttcgagcgcgtgcgtgaatatgtttactagcatggactgaaattctgcaggagtttgctcctttattaatcttgaaagtttagacccactagtagagccattgttaagatgtttttcatcgtggttattgtcagcgtgtgcattctctgttggcaaataaatttttatgatagatttaagctcagtgatagatttttccctgtataggtcaaaggcactcgttaattcttcgcatctattcaatctgactattaattcggttatctttgaagaaaaattatcagtaaatatagtttgctttttatcattagatcccgtttgtatcctatgtagtgtttcctttggtttgattgatttgcaaaaggatcttaaatcatctattagtaaaatcgataattgtaggctgaactttcctcctatttcaatcttcatattggttaaaaactctctcgttgctgacaaagcaggtatcgtcctcaaattgcttaatttatagggccaacacctagtccaactctgaacatcttcgtttattgaatcatcccccttaatcagataatcgatggattttatcagctctaagcagttatccaacttgttctcctcatacattgacttacactcatctgttttgttcagcactaacttcgcctgtaataatccctgttctagtttctctacattcttcctcttaaaaatcatttctaaatgtgaaattttttttcttatattctctgcgtcaatggtcttgatattctgtgctagctccttaagctcgctcattgtgtccaaggctcttttctgaatattgtcaacttcacttagcgcatgaaaaaatttgtgtgaggatttggatatctctgtaaccagtaatgtttctacgatatccaaaaaatcgtttagcctgtccctcaactcagaaaaagcctcatccctttccgcttgtctcttcatgtctagtttcgttaaaaataaatcgatagcgtccaacactttatgaaaagttcgagggttatctaattgaaatttgtctgaaaagtaaaagtcaggtatactatttattagctcggcatccccttgcctcagatttgcttcaaacgactcctcatgcatattttccccttctcgcagttcttttaactgttccatctgattcatgtttcttatattatttgtgctttgaaatatttggtaatcacttttaatgtttttgacgtattcgataacatgagttttccaatggtcatccagatcatttttgcttaggctaacttgtggaatatcagcaacagtggggtaattgagccagtttttcctccttgtgttcatcacaatttcatagatggagttatttcccaatggcgaaaagtccatggacccactatgtgtttcattttcaaaaccgaatgatctactatttgcaacagatagtgtcctagaatcaaaacttcttcgcggcgttattgaatccagacttaatctcgaagatcttctcgctcttggtgtgacactgccagatatacttaacaagtcgtcattaagggaagtatcaccctctatagtaaaagagccactatcactattacgagaaggcgatccctcaggaacaacaattttaggacgaccagccgctttttgcagtccctggcttttattatgaggtgtttcgcttattgacattggccagatacctcaccaaacctttaaattgttttaatactgctttaggatatcaatactgccaattactgtaagctctgcctaaaacaaagttgtgcctaaaacaagccgtgtcgtagtttgttttgtttactttctagactgttgtgtggtgtcttctttataaaggaaaaaccctttaaagatcgaagaaaacattgattgtactctatctgaaaatcattacccacgaacatatcttagatcagctgcgtttaattgctaatatatagaacacacatacgactatggaagctcaagaagttcttgtacataagtaccaaatattgtaaaggtataaagaagttttgaaatctggagcgaatttaattgtgtacgtaaaataactgcttcgctgtctacatttgtccttgacaatgccagtcgattacagcttacttggatcctaaagacggcactgatccacactacctggatttttattttctcttcatgttgacttcaaaattctttcttctaactgctgtcatttccattttcttgtggcttgacgtcactctttttccaagagtgcaagtacttgcttgccatacctcttgcattctgcaccactttgtgtaagctttcattactcgaatccgtcaaagacgcttcttttctagtggtttgcacgctatcaactttcttgtcctttagcttactagcattatttatatggcagttttcaaatccttttgccaaagtgtccatttctgagtgatcttgatggtccatcatatttcccccggaaacaacagacttgatagattcatttctaggagagaaataaccctctatggcaacatcactcgcccccacttcggctggtgaaggagtattatttacaattctaaagctttgtgaactatcggacgcttttggctgctttggaagggcttttttcttctgagatgatatgtttgctggtgtcacactgcctttcaatacgcttcgattaaccagctgactgttagcgggtaatggtctttgttcctcctcgctgctactctcttcttcactatctgaattgaatatgaagttccctgaagaggaattgcgcttcaacggatacggcctgacagccagttgtgcatctttgtctacatcagttttaccccctgtaaaattagtaggatttttttgttgaggagttgccgaagagagtgatggttgtgctagatcgtacaaagaattggtagatcctgatttcccaagtgacaatgttctcctcagtgaaagtccttcatcgtggttatcgtctacttcttggtcatcgtcatcttcttcctcttcgtcgtcgctactattgtattgtgagtcttcaataaattgctgttcgctatctgatgaagagctgtaattgtcgtcgtcatataataacatatgcgatccatgttgacgtgttgtattatttgctgaagctttgtgtagttgtggaacatgtttttccttggattctaccgcattgttaaattcatagtttgatgcattatcatctgcaatggctgtttgtaagtccattccttcaggaacatctacaatgtcacatgaatctactggtaaaaaactggaagtatcaccagtgtagaccgagttataatcgtatatgtaatcatagcctctggaggtattgacgttatgtgacacagcattaccatacccattaaattcgccattatcagattcttcgtctgatccataattcaaagtggtatcaggaagcaactttattatgggacgtacatgagctctggaagtagtagatgaagccacagaggaattatctgttattggtgaatgaactccagagtcagacctcctggaaaatcttgcatttatgtaaaggccgccgtgttcttcatcatcagaatgtgatgaagatgatgattgtgaggatgtatcatcgtcgctagtatttttgttcaaatgttcagttgcggagttgataggaatagatttatgctgaatggctagcaatggagtcctattgttgtttattgttgtaacgttcgcattgttattaacatcaacatattgtttattttcatcatcgctttcatcatcctccgattgtgaagctggatatcgtagtgccatacattgttccaccctgtcattaaaatgtatatgtctatttttagtaggtttgttagatttttcacttgggtttgaggttaatattgatgataatcccatggaattgttttcattatctctattggaggaagatgttgaggaggggaacctattattatcaggagaatttaggttttgatccaagttagccttacgatcattggtactattttctagtatgcttttgtttgattgtgccgttgacctattgttttgaacatgaagcgctgactttaaatgcaggtcttcttctcccttgtcaccgccaccatttgaattttctcctacaggattcggtatggtagaattatcttttttgtcagagtgttgactcttcaaactaacgctactgttcgattctttgggataatggtagtactgggcgttaacttgagcggccagagcatcgaaatcgtcatggacgtttttgttgccattgggatccattattaccgaagcatgtttcatttctgtcatgtgttttcttgcctcattcagtttccataaagcgttgtcctctataatttctgtgacggttctcttcttcaaaattggtttcggagcagctgcgatcgactttgaatttttagtgggcattgaaattctcttggaattttcatcatccgaaccatatcctctttctagatcatgttcttcttcactttgggcattaccttcagaatctcttacaatagggccatatagccaagtcacatcagaatcttttgaccaattaaccacttcaggtgacactgttttcaagttgtttcttgcttttgcccatgttctccatgaggcattttctaacctagcagcatttactagatcaacatctcttttctttttctttaggatgatatatttccaagaattagaaatttctgattctttccattcatgtgacagatagtcaacatgtctttctggctctaccactacgtcattatcatcttgtggaattaagtagctatcattatccgccggcggtggagaaacggaggttgagtgttcctgatagccgtcatcataatcatcatctgaagaattgcttgaagaattattagatgagttgtcataatattcattgtcgttatcatataagtcgtctgaccttcctagcaatttcttggtagggtcaatatattcatcaagaaggcccattgatcttgttcttttaaggttgaaagttgatttatggaaatcatcatcatttttcgcttgaacagccatcgatactgaaggccccatatcttcgtcgttgtcgttatcgttaccactaattttgacatcacttttgctattactttcatggctcgcatttctatttacatgctcgttttcaatatctttcttaccggcgaagtaatttgctagatttgttgacatttttggatttttcttatctcgtcttcgtcaatatgcttgctttaggatttataatcttcaaggatattatcttttcccccttgctttgacttttcaacgttcgtacagaacaccaggtgtgtggttatacgtataacagccaaaagctagccctcgtaaaactagtataccaattagttctctttcaggaggtggtgttaaaaaaataagagagataaagatgagcaaatattatatcttgatagagctgatgaacgataaaaagaatactaactctagttgtgatattttctctttctatttaaatttcagcgataaccctttctcaagctttcgtttgaaatcgcgtctcctatatggtatattctcctgttttctccttttttattccttaaaagacctgataggggtattcaaacaaaagtatttatatttgtctattcttcttttatggcttcttgttctcctgttctgtcttgcaaaaggcttgtcacacaatctcagggctgattccttccttcaatatccactgtgagtttaaatgcaaacaaaaatagagtgaataaaaaaagctttcggcccggaattggttaacccgacttaccaatattatgtcagaaaagaggctacagctgaaactaaggtgaggtggtaagaaatgctctctattgaaaagtatgcatgaagtggaggataagaggtgaagcggcttggtaaaatatacctgccaagtctgagatgaaagcatttgtatatagctattagttgtatattcgtgtgtagcgatatacgtttccgggtaatacaaacctacattggttcaattataagagccgcgaagactattatcatattctatacggcatttattacttatgaacattcaaagatggatccgccgtcgctaacggtgttgttgttagttccaaagaacaatttgaggccaactgaattcattatatttgtttgcacaatcatggaactaaactgacaatgcgaagcctgatttttttttacctgattaaccattgggtattcgagcttgttccaaagttttttttcctccgtattgtatatttctacttcaccattgtcagtaatacacagtaaaaacttgtcaaaccaaagcaaccttcgagatactctttttttgtatttgatacggctcaggtcttgtgttcccaactgggaataactagctagaccttctggttgcagaatttccgtaaatggcctccaaacattcagttttccatccatgccgactgaacatagctctgaaccctcactattccaaacaatgtcactgcaacatctcagatgggcttttgattggttagagctgaaatagacatcgctttgatcgtcattatcatcgttatttatagtcttgaacctatttttatttcttttcaattctgaatacagtctgttcctcattcttagatcccataattttaccccaccctccatgtcaccacaagcaataatctgttccctgacggggttaaatttgcagcataaaatttctgattgcattcgtgtttgatttcccattccaagcgcagttacccctgaattcatggttctcaggtcaattaatcttggatagtagtcttcacttgccactacaagcaaagaactgtcgtcgacaacgttattatcaatttgatttattttataccccaggtttatatcttgaaccgcttcaaacctgtttgtgtcccatatttttacagttttatcatttgagccagtaaaaaacatcccattatcagccttataccacttcaaagttgttataccatatttatggtgagatatggaagcttctgaatctgtttcagatagtgtctcactaaacccgataggagaatccgttttatttgatatgtgtgatctttgaactggaactgcagcactagactgtctatacattcgatatttgtttctctgtgtttgaaaactgtgcaccagtctcatagtgttgttgtcgtttattcgtgttcttttatttttataacccattatttgagcaggctcatcatctgattggtgaggctgtcgcttgatatagtttagccttttattgatcaattcctgttcaccttcatcattgcggtgcaatgattcatctaaaccccaaatggaaagtgacccatcatctccacctcctaataacacttgaccagtatcatcaatatcaagacagttaacacctatacttaacggtgttttttcttttgtactatagtttgattgtttactaaatctgtagtttttcatatttgataggggatcttcaaggatcctctcaaattcgctttgaatagttcttctataaaattcatttaatgagatattgcctactctgaactctaaaaatggatccattgacctgtacttacgtcccagaacgagaaagagataaaattttatgttgtctgtggtctaatgggagatgagatagcgatgcttttagctgcacatccgagttcggagttttttttttttcctacgcttaagaaactattcaaagtaaacttgcaggtccctccctaatataaagacatgttcctgtaagcaccgagctaataagttaaagataggtgaagaagatgtctgatattttggatgagattgtcatagaagatgttgtggcaaattgcccccaggagtttctgcaatatcataaatgcataagagataatgaggaaaatcctgggaagtgtaaagatggaagaatgatattatctacatgcattagagaaaaagtgcccagtgtgaaaagtatcatgagcgaatgtagtgagccaatgaagaaatatgaccaatgcattcgtgataatatgggtacaagaactattaacgaaaactgtctaggattcttacaggacttaaggaaatgtgcggaattgcaggttaaaaataaaaatattaagccttcaattaatggagtaaacttgaattaatcaaggactgaattaataggcttcctttgtttatttccgccatttttatcgttgcataaagacattatatattcctgtgaatattttttaactaaaatgtccgaagaaattactgtatttaaagtatatatattttctaaagatacttaggtatacctgacgggcagtccttttttcatcacagaataattttcggtaaaggatcattcatttccataggtaggagaagtaatacttcaaattatttcaaaactttgcaacggtttcgtagaaagtcttgccttgaatttcgtgtacttgtaattccaaggcggaaggagatcttgaaccgtcactgcctgcaatggtacccgcaccccatggtgaaccaccgtgaacttcatccatattggtcaattcagcgaaaacattcttgtaacccaatgggacaaaaatgataccgtgatgagccaaagtagacaaagagttcataattgtggcttcattaccaccaccagttccggtggagacgaaacaaccagcgaccttaccatgcaaagcacccttagcccacaacccaccggtacggtcccagaaagccttccattgagcagggaagttaccaaatctagttggaataccaaacaaaaaggcatcatattctgtcaacgtatcttgagtggcaattgggtaatctggctttggagcaccgccaagcgccttaacaacttctggagacaacgtttcctcgacttgataaatgtctgcagagcctccagcggcttcaattcccttcttttctgcctctgcggtggcagcaacgtgaccatatagtgtgtaaatgatgatagctactcttggcattgtatataattggattcttttaactagagagtggtgatgatttattgaatatattattcgacgatatttaattatatgagaaaaacagtaaaaagaataaggccaaatgcattgatcgttttgccgctcgttgacgtttatatatattttattgttgtccagagagtaactgtactcaattgtgggaaaggggttgctaacgaagccaaggcttgccaatacactgcgcaggtgcagccccgcagaattattaattttttactaagacagtcaagagacgggtaagcgatcgcaatgagcggcaataggaaaaattaataatgaatcagtcagcgtcgcaaaagccacaagtaaaacgatttaagtccataatgttatccagggaaacaagccaggcgcacgcaccttaataagttggacactcatcaaaacgcatgagtccctctgtttccaaggccaaagaggtggcagccaataactattaagttacgctagatgtttcgaaccacccaggtcacactgtcattattagtagtacatatatatatatatatatataattatcatttaaaaggagatatattactgataatcaaaatagtaaaaactacatccggagtatgacagtccaacgattatgtagtatactccttttcacgtttttgcaagaaatattccttcttcttgccatgataaaaagttgtatttagatattatctcgatttaagtggctcttcttttatttcttgctactggtggttttttttgttgtctttcgtcccaagacagaaaaagaaaaagaagaatataggcaaaaatataaaaaaacaaaacaaaagaggaaagggaaattaaaagaatagcaaatgctttaatcacacactttgcgcttcctacaaaattacggcaatgattttggatgtaacacgtaaagataaatagcatagttcgctttcttttaaaagaataactcttgtttcatgaaaggattttggtatggccccgcaaaatcattcaattttttgtcataatatcttctctttcacgatatagattcacgcaagggcgctcacagcaatgctatctcaattgtagaaatctgcgaagcgagcaaaaggcgcttaattttgaatgctccagtcaaggcgaaagagtttttattgaagatgcaagatcttatgcagatgtaaggttagcggtaatgtgtactacatgcataattaataaagaaatctaaattacttcgatgtgctcatgctcatacacctaattttgttttcatatttcaatgcctttacaaaaaattgagaacacagagaaggcctccgatttagaatagtacaaaatatctatttttttgcatttaggctccgtatagagtaagcgaagaaaaccgcctgattcaagtgattctgcttttttggtttactttccacgcagattggctgctctgtttgtttatttgttttgggaacgcggtattacctctcatttctctgagcgacttttcaacttggcgcgccgacatttgcgcttttttttacaagttgtcaaactctcggattatttaaaaaaaagggttttttgctcttcttgttcccatctacgggtttcacggaaaaactaccccgaaaaagaagcacagctttataaaaagaccgtattaatttgctttattgggtaataacggggcattcgggacatacaatcatacgctagatgctgcgtgtaataattaacattgtaaatccctatcttttttttttatataagtagagtactttaaaaagagtggacgactgagttcatatacaagcagacgccctttcatttaatctcaatcttgtttcaggccggcttttgtccataactgctacgctgcgtaaaaaaaaaataagagaaattgaaaaatatgggcgtcgtctaaggatggtaactagcttcattatactatgggtcttccttcttttccaacgcttccactttgacctcaatctcttctcgatggcctaaggtagcaaggttgtgttaaaaaaaacaaatacatcagagcaagacacttttgggtttattaggtattataggtataggtcaattaatttcttatcttttgttgagaggataagggtaatattagcgacccttaagtaatttttgttctgttttacttcagtttaataaaagcgactgccgccgaccttactcccttttttttattatgctcctcgagacaaggtcgcttaaaaaaaaaaaaaagcttagtcagacatgcaatcagcgcaatttatggaagctggaaaggggggccgcattttatgcactatctcttgaattcaaaaagtaattcaggccaaattaactaaggatgcaaatgaagcgagtactgaacgaatagtcatgttctgaatttcaagcattcaaattttgcttttcagcgctgttcatcttagcgcttaccataaagaggaatacgtaattcaacaacggagttgaaaaatttttaaaatcgtgccggtgttagtgagaagaggatggagggaattaatacttcgatggaagatgcaacttgcaaatgtagtccggttaccaagagacccaaacctcttccactttactatttctcctttgagaaatatatcagtttgcggtaataggtaatatgaaaaaggcaataaaaaaaagagatacttgtcaccatctcgtctccctttaccttttttacttaatcttcttcgtcgtcatctgttccatccctttcctagcttagtcttctccggctagttcttagtgcggtgagcaaaaaaaatagcgttttttttccctcaccaggactttttttgttaaccgaaaatcggcatctctagttttcctggacaaaaaaggcaaaatggaaataaacactcatacgaatcagtaaagatgtaaataatcgcagtaacgactgcacaaggatgtcagaaaaagcagtttaattccagaagtggttttccaatttatcacacatgtacatgaagggaaatgtataaatacggtcttcgtaaaacaaaggatctcttcacctggtttcttcatttataagtagtgtctttttcggtaacttaagatatatccttatttctttcccacttctcgttatttcttctttttcccttttcaagttcttctttttatttattattaagcttattttaattcttagatcgttgtcactatcttttgtccttattgttaagaaacattgcgaagaaaaagaataataaaagaaactcagaaaaaaaaaaagtttcctcgaacaaaaatattattatttcaataactttttctttctctacatccaattttttgaccctattttaacattaattttttgctttaattttaactaatacctaatttcacttaatatctaatcatcttcctttaacccacagaacaaagaagaaaaataacaatgtctacctttgaaactttaattaaaagaggtggtaacgaagccatcaaaattaaccctccaaccggtgcggatttccacatcactagtcgtggttccgattggttctggacatgtttctgttgttacctattatttggtttaattttaacattcttaatgttcagaaaaccagtcaatgacagattcttttaccttaccggtattgctccaaactttttcatgtgtatcgcttatttcaccatggcttctaacttaggttggattccagtcaaggctaagtacaaccatgtccaaacttctactcaaaaagaacatccaggttacagacaaatcttctactctagattcgttggttggttcttagctttgccatggccaattattcaaatctgtatgctagctggtaccccattctggcaaatggctttcaatgtttgtattactgaattcttcactgtttgttggttgatcgctgcctgtgttcactccacttacaaatggggttactacaccatcggtctaggtgctgctattgtcgttagtatcagtgttatgaccaccagttacaacttggtgaaacaaagagataacgatatcaggttgacattccttgttttcttcagcattattatgttcttgtggattattgcttacccaacttgtttcggtattaccgatggtggtaacgttttgcagccagactctgccggtattttctatggtatcattgatcttattttgatgtgtttcattccaactttattggttccaattgctaaccacttcggtgctgacaaattgggctaccatttcggacctagtgatgccgaagcagtgatggctccaaaagctccagttgctagtccaagacctgctgctacaccaaacttgagtaaggacaagaaaaagaagtctaagaagagcaagaaatctaagaagtctaagaagtctgaagaataagccaatcgtcatgtcaattatgtgctactttcttctttctttcaatcatctttgaagaattttctacttcaagccaatcctataaatggataaaactgtctttattgattatttgacaagattattttactccatcttcaacttttatcatattttattttattttcctgacgtttcaatattttcgttcgttaaattatcaccatttcttgtcgaatttttattttctatcataaagtgcaattctagactcattttttaatttaatggatccatttaatccatttcgtcaagcaagtatgttttcataacaatattttgctcagtgcattttgatcaagaaacgtatagttgatgattagaaacgagcttttttatgcccatcgtcatctatatatatatttgtatcactttaatagttattttaatatttgataacaacctttctaatagtattgttatggaaggtttagtgctggaggaaaaaaaagaaagataaaggcacggtgcctgctttgcgcggcattctcgagaaaaatagttctcggacttttgacgtgccagtgcaattatccgtacacaattttatatcaatctacaggcaaaattattacgtaaacagacaaactaccatgttaaaacgtcttgttcttctaacctgtaattttgatttttaccataccagaccttttccagtctgttaagattatgttctgtgagcttttgaaattttccaccattgattttataatatcttttaacaatcgctcttgtttcctcgtccattgcattcaaacctgcaatcaatacagcaaaattactataacaagtccttgaattttgtggcggcgagtcactgtctaagaatttgaagaaagacatgattttcttgaccacttgttgaatggtacttgactcttttggcatacctaaaagttttaataatacaattaataagaaagataaaacttgtgtctgatgagaaatatcataccagctgatggcaacttcttcaccgttctttaatgtcaccatatcgatggcattatcatgaatattactaattctagggtgtgactgattgtctgagggtataattccagatttgtcaataaattcgtaatctaattgcttgtcaatttccactagaattttctgcgtattgaaatatgatatctggtctttggacttttcggacgaagtttgggatgataaaagcagatagtctaatttcttagtgaacaaaccttcttctttagaaaagtaatttttttcagttgacctaattgtattgagtgatttgaaaacttctttaataacaagatcgaaatcttctttatgtcctcttaaaagattaaactcatttagtggagtcataatatttaaaaattttaacgagtcaacatattggtaatcatatggatcaaaaattgcatcaaggtcattattatcaattaaagatccgccaaataccgtacttatactggcgaatgtttccataactttaaaccaacattttgcaacgttaagtactttggaggaattcccggcattgatttttttaaaaaggtcagttacaccttttaagtgagacctccattgagaattcattgaataaatacaatcccatgcaagcatgatgaccgtcaggatgataggctctatcctatttaaaacgtttgactcattcttgaattgttcacccaacaggctcaggcaatgtgacaaataagcacaatagtttcgttcatcttccaagttattagactttctatatgctatagatgctcccgtagctaatatggaagataaaagataggcctcgtttttcgcaaatgaaagtaagatatctcttaacgggttcccttgattttggaaaaagggcgcaatagaatctaagcaatcgtagtaaaatatctttagatacttatcgtggattccacctagtttgaacgagcttagttttgtgttgaaagttattacattattcaccagaaaggatattggtacgctactgttcacattcgaagcgggcaaaagttcaggtatgtccaaatcgggcaaatctaatcctttcagttcttcattcaataagtaagagtcatgaagtttcatattaaccatatcattcaagttctgcattagtaaattaacgtcatatccattcattgtggtggtaaggtccaaatttggaatctctagggattctatttcatccaaaggtacattcttgccgttatctgtaatcggtttagggtccgtggtgtcttcacttaaattttgtcgtacttttttcttcttctcagccttgcatgacgaatgctgacgcttgcgagcattattatgatcattatcgaggctagtactgtgcttcctaaattcttttactctttgagcatttgaggttcttcttttcttattttttgggtttaaaacgtaaacgcactgacgattcaatcttgcgcactgccaacaagtcggtttagtttcatcacatttcattcttcgtctcttacactcggagcacccatttctggagtacttccgttttactgtatttcccttcttatccgtaacagttgaagttacagcaggattaggggtcaacgatgagtgtccattatcatctgcctgtgaaatagtggggtgatctgcattttgatcttgctctgaagtagtgggatgacctgcattttcattactgccgtcattactacttgtggtcgattctacattttcgcctcctatattcgaatttgacggcgaggtcatctgtttatgattaaaaatgccacctaaagatcccgctctagcatttaaaaacgataaggagggtagattgttttttggttcaaagcaactagttgaagtcccactatttgtgaacgatgaaccactgtctagtgaagctggagaaagataactacccggtggggacaaaaccttagccagttctctatcctctggagaattttcatccaaattgacagattcgaacattattgccagaaaacagatcttataccaaaatgatgagagaaggaagaaacagggagataaggactaaaaaggaaaatttatctagcaacgttcacagcaattcctgtagctacgtgatgacctctgctgggcttttcttattcgcctagactgaagtgatgcagaacaataagcattctaatcggcctatggttatgattttgaaattcctgaggaaatttttccactgtcatttcttccaattgagtcacgtcgcgtcctcgtaggcaatgatgtgcaacttgaagcgcggaattcacggctaagaaggtgtcgttttattcataccgtgctgtaacgctgtttggtcatcgtttccttgtgttatcaaataagtgaggccctgtctctgtgatctataccagcagtcgcctaatttcgtaatacgttattgtagacaacaatttcttgaaaaagagagaatgtgtctggcttgcaggaaaagaagatggtgacatatgcttagacgagattgtacattctgcataatatagcgagtcagagcacatgtttagacaatatctgatttaaatttcaaaattagggatgtatattctaaatgtttatgcgcttaatactatcgatgatttctgaatggttgcctgtttcaatgaatcctttagaataaagaacatttttgagcattgtgtaatttatttagcaaggagtaaaagccaagcgtatattatggtgattttttttatcatgcttttgagtaacgggtaatgacatacattagtgacatatgctagaaattatcctcagattttagaaggctacttcaaaatgttgataataaccataaataatattataatttttttcttcttttccttttcaggagtaggtaaatattgaggtaattcttgagtttcaatgttggtaaaagactatagcattgggtatacagagtttactagaacacctcctcagggatataggaatctgcacaagggaattgacatttcaaacatttcaagtaatattgttatttttcttttcattttatgtgttgtcagtcattaacctatcatattatcaatcactgcattcagattccattagatttgatggcagtttctcaatctttatgtgctcttcttacaccattgagaaatgggtgaatgttgagataattgttgggattccatttttgataaaggctataatattaggtatatagggtatactagaagttctcctcgagggtctaggaatccccataatggaatctatatttctatataccaatattaagattattcctcattccgttttatatgtttcattatcctattacattatcaatccttgcacttcagcttcctctaacttcgatgacagcttctcataacttatgtcatcatcttaacaccgtatatgataatatattgatagtataactattagttgatagacgatagtggatttttattctaacaaccatatataataatataccagtaacacgaatagtacttaatagacgatatttatataatagtgtccttcttcctaagattatatgatgcacaagaaatgttgagaatgtggattttgagataattgttgggattccatttttaataaggcaataatattaggtatgtagatatactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggtatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtactttctctttatattcatcttcatctatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatttcgttatcaccttcacccagatttattatctttgtatcgtattgtttcttgagtgttgttatgattttcttatttgcatttaagtctttgctgaataatatcatatcatcaacgaataagcaaattgttacttgactattcttaaatacgcatgaccatccgcgaacttcttgcatgtcgcaacaatttattaaatatgatttaatggtttcataccagtttgcaccactttgtttcaaaccatagagtgattttctcaaacgtagtaacttatcattcaaacctaaatgtggtggaggtcttatgtataattcttctttgatatcagcatataagtaagcagaggatatgtccagctgtgtgatataatagtcattgtctaatgcgattgacaatgacgtcatcagtgcatagtgatgtacggtattggattgcatatcagaatcatatgtatcggggtgttgaatgtcgcctcttgcaacaaatctagctttgtgtgtaccatcacgttttttgttaaatataaacattgagtttattactttcttaggatctatgtcatttctatcataatatttgtttgtatcccaagtgttcattctcaatagttggttaatttctttatgataagcttcaatatatctgtctttttctttgttgtcttcattatatgtaattgcttcatcatatcttaaggtcgttcgaactggtttgattgattttactccttttattgcagcaattagatttatacgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagatttattagttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcgcatgcagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatatcattgggactaccaggtcgcttttggtttcgtgcagtgaaggtagacgagtgtctaggtgaagtagtatctgattcaatggtaccacccatttcggtactctctttattaatgatatggggtgtacgagatcgtatagtagatggaagaatattgtattcagatatgtcggcatcaacttcttttggtgcacgtactttttggactggttccttgtctaattgtaaagggtttattgattgggacgagaagtcgttcactagaggatcagagtttatttcaatctccgattgatagtcatgatcagattctgtattttgatcatatgactgctctgtttcatttttttcaataaaagattggttatgggctgttaaacgattgagatcatcatcaaaggtgagtgtatcataattgaattggtccaatttggattgcttgtcttgtaatataacgtaattggtagtatctactgtcttttttaatgatggaagatagataatatagccataagagtttcgtgacggatgtaaggcgtaacctggaatgccacgaggatgtattttcgagtcgggattatggttgttaactataaccggttgaccgaaaggtagtatagtagtaatgtccagtccagctaaacctgcatgttgtcttgcagatttatcgttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtatgcaagtactgaaaaggctcatatgattcttggtactttagtcgtgatcctttgacatgtctatgtttcgtgcttttgccgattagacagtcaggacattgatatgtgctagcgttagaccattcaatatccgattccttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttgattagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctattgtgtgtgttggcttagattctttctgttgctggcctaagactaagttcgttgtcatcgcttaagtattgtgatgaaacggttgattcattaatgtgatcattgttcacccttgagaatttactagatgtagcaatattgtgagcttttgctgctcttggttttgaactatttgttctctgataattacgagttgtaacctttgtgttagtcgtgtttggagatgtgcgagaaacatttttgtattcgctgtgttgtttgtattgggacggtttatttagattcatgattttattttcgtcatatattaattgaatttcagcgaataattgggaaagtttcatgttcgttttggtacgatattgattacgtaggtatttgaagtcaccggatagacctttaagtattagttgacaggccaatctgtcgctaacattgatattgttttcttttagcctctgaatgatcgtactgactgtaatttcaaatgtatcagcagatgtacttccgtcgtactcaaggttggcaagagctatccaatcctttaattcttgattgttagtttgcattttggacacacttttacaaaggactgtaaggatgtcagcataattaatttctaaaatttgttttacccatgttggcaataaatgaaatggggcaaatgcttggaaggtattgtatatatacgcatgttcttcataagtcatttgtcttttgatttcaccctggtcatttggaatgatgtcaccgagattagagttcttcaaaaatctgatgtaaaatttaacccatgtagaaaagttttcttctgatgttaaagtgtgtggtggtaagacgttatttcccacctttgtcttagcttgaggtatttcagagtgttgattttttaaatcgattggatcaggtgaggaagtactcagtggtgggatatactgtggcaacggatagtgtgggtccggttgataatacgcaggtgacgtttgataatgtgaacacgtcatcatagatggttgttggtaatgtgcccagttagaggccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaattggaagctgaaacggctaacggatcttgatttgatgggacttccttagaagtaaccgaagcataggcgctaccatgaagattgggtgaattttgagataattgttgggattccatttttaataaggcaataatattaggtatgtagatatactagaagttctcctccaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacaagaaaaatacaatcttcgaaagtcatcctcccttgaatattctttcttacctaaacgaataagaacagaatctgaaaacaggcaagtgattttacggagggttggccgagtggtctaaggcggcagacttaagatctgttggacggttgtccgcgcgagttcgaacctcgcatccttcaataacttatttttttcctcaatcttcgatattagacattttttttttcctatgcctcccttttccaagtaatgtttttttttttttttttttttttagctcctctcacaaaagtactgaggactgaaatgtaaaaactaataacacaatagaaataatcatatgatgatatagaaaagaagagaggagacaatcataatattatacgaactcatggctttccttatgggaaattctacattctcgatagtgaccctggtatattcaatatacttaggaataactgtctttcataacaatggcggccatacgattaccgtattatccacctattcttgatattaaactggaaattctgtgaattttgtgataattgttggaattccattgttaataaaggctataatattaggtatacagggtttactagaagttctcatcgaggatttaggaatcctcaaaatggaatctatatttctacatgctaatgttacgattattcctcatttcgttttatatgtttcattatcctattacattatcaatccttgcatttcagcttcctctaacttcgaagctttccataacttctgtcatcatctaataccgtatatgataatatattgatagtatgaccactagttgatacactgttggaataaaaaccaactatcatctactaactagtatttatgttactagtatattatcatatacggtgttagaagatgacacaaatgatgagaaatagtcatctaaattagtggaaactgaaacgcaaggattgataatgtaataggataatgaaacatataaaactgaatgaggaatgatcgtaatattagcatgtagaaatatagattccattatggggattcctatatcctggaggagaacttctagtatatctacatacctaatattattgccttattaaaaatggaatcccaacaattacatcagaatccgcacaattatcatagatgataatggatttttattccaacaatcagcatgccttttgtatttctgtaaagaagagtaaaccataacctaagtcaatatcaaatttaggattgatgaattttctactcaaaatgctttgttcaagaaggtacgaaagaaggttccaatcgtccattttagggtcctatagtgtagtggttatcactttcggttttgatccggacaaccccggttcgaatccgggtaggaccttttctattttttaaccctcttgttttatttttctttcttggctttgaattgcacagcccctcgcattttttttcgataccctgaaaaaaggaaaaaggcgaagaaataagggcaatttctatttaaaaattatacaagctcgatttttcattttctccttcccctctcgcccctcccagttttcaactgtatttaaatgtttctcagttatgttgtgaattaaaataatcctaattgtcaactaaaaaagtctaagttagcaataccaaaatgaggcatcatcaaaatatgcattatgccccacaacaacaaccagtctatgtccaacagcctcctcctcggagagaatccggtggttgctgtagaacctgttgtcacttcctatgttgtctatgtttaattaacctatgttgtgacgttttttaattctaatcgacagctaaaaattagtatggaaagaacatcatatttagccgctgaaaaaaaagaagcagctgcgtatcttctcaaatttatgcgtacatagtgacatatatttaaaagcttcctcactttccttttttatattttttcattgctcaagtattagtcacatcggaaagtatgcttgctgcattaaatacatgcatgtgtttataagtgtttgcattttctctctcttcttttttttcttcctgttacttgtatacgaacgacatatttattttcactatttctcatttatatttatagctactacccctattacgttacaagaacactttatagcattatgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatagcctgtaaatgagggaaaaatgcaaataatcttgaatgatactcaaaacttttgatttattgtaatttctttctgaaccatatttattacattcaaacttttttttttttgccttttataaaaaaaaatacttataagaaaagagaaagaaaatgacagttttctatgtatcattaaataaacatccatatacaaatatagcgttatgttttacttttattatttacatgcatagaagtgttggcaaaattctttacgagccacggggctgctatttcaggttttatttccatcttaagccatcgttaacttcttcacattttctttcacaaacaattttacatagcgattggatacccagtttccctcttctagaaggaatcacattggcaaagtgatttagtacttctctttcggtaactttggcgccagtgtcatcattcgttctcttttcaatatacgcagcgatttcctgttctgtaggcaattggtatttagaatggtagggatattgagtccaagtaacattcgaggtatttcttagtaatgacattggtagcgatggtttaggagatgtgatagatgtcaactgagatacaaataactgttccttctttgtccatggatacgggaccctttgtttatcaataagtttatgctttgtggcttcagagaattccaccaaagagtcctggttcatgcacatgttagctgctgtgtataagtctcttttgatagcagattctatgtgatctctggaattctcttgcaccaatctcaaggcgatttgaagagaggatggtgacttggttaacaatttcgttttgatttcttgtgcgaaagccttaccttccgcagaaccttcatattgacgtaagttattcattatgtcttcaatagtaccatttttagacaagttaaaacaggcttcaataacgtttaatttctcgttagaatacttgaaaacataatcttttggtaatggtgatacgaattcgtcgatggattcgttaaccatcccgaagaagtatgcagattgtggatcgttattaaaaggggggctaatttcacctaatcttttctgcaaagcatctaaattttcactactgacgtaatgagacgctaagccgagcatataagcgtctgctcctgtgactacttctcctgtaagacatagatacagggccatttgtgagtttgagttagccaatgtcacgattctagggagagcaaaagttgagcctacatctggaaaaaaaccaatgtccatctcgggcatggcccatttggtgttttctgtagcaattctaaagggcgtgtgaatggatagaccaacgccgccacccatggtgataccgtccatgaaggtaacaattggtttcaagtaagttgctatttgaaaattcaaagaatattcatcagtaaaaaatttgatggacttggcaaattctttgttaaaattgaatattgccacagtagctacatcaccaccagcacagaacgaacgtggtcggttggatgactttaaaatgactaagtttgtagtatcgctctttgcatactcgttcaaagtcttgaacatggattctgacatttcggcgttcaaagcattgagctttttgggcctatttagcgtgataactctagctgtatcttgaacggtaaatagcacaggtggtgcgtcggtgacatttagctggggttgagtagtcatgaatgtacgtgtggtagttttaaatccgtatttagacgacaattgggcacattttagcgtatttctgagcattatttgtggtggctaaacagaaccaagtattatataaatgaggattcccgtacacaggcgcaggaaacaagctgctcttatcttctcggctacctcatcaatcatttggctccgaggtttaacacttttctttgcacttgcctctccaattccgaagttccgaagggtgacccggattgtgttactaaacaagagaagattggtagaaaacgcaatgggtcagtttggctggctgaatccttggaatcctgtaaggctgcttactacaaatgggttagggactgttctcttcggcataatgtttaagtgttagttttgagatattacatgtttaagaattcaaaaaacctttctattaacccaggaaacgatgcggataaggcgagcttctccgacccatgagcacaatagatcaagttctgttctagttgttggttagtagtttatggaatgctaatggcattagtgatgtaggaatatttttggtgtagtgtatgggtgttgtgaaaatatttgccatttgaatttttttcggcgcttttctttttttttttcttttttttttagcttgaattatcgatgaatgatgaaatgactcttaatgaacttcgaagttatatatacagccacttttttgtttagaaagaaaagtataattatcttacatacattgatttattgctctgtccttcctccgagaaatccgtaataaacttcaatagcataatgtctcaacaagataatgtcaaagccgccgctgaaggtgttgctaacctacatctcgacgaagctaccggggaaatggtctccaagtctgaattgaagaagcgtatcaagcaaagacaagtcgaagctaaaaaggccgccaaaaaggctgccgctcaaccaaaaccggcttccaaaaaaaaaacagatttgttcgctgacctggatccatcgcaatatttcgaaacaagatctcgccaaattcaagaattgagaaagactcacgaaccaaatccatacccacacaagtttcacgtttctatatccaatcctgagttcttggccaaatatgcgcatttgaaaaaaggtgaaaccttacctgaagagaaggtttcaattgctggtagaattcatgccaaaagagaatctggctccaaattgaaattctatgttcttcacggtgatggtgttgaagttcaattgatgtcccaattgcaggactactgcgacccagactcttacgaaaaggatcacgaccttttgaaaaggggtgatatcgttggtgtcgagggttacgtcggaagaactcaaccaaagaaaggtggtgaaggtgaagtttccgtcttcgttagcagagtgcaattattgacaccatgtttgcacatgttacctgccgaccactttggtttcaaagaccaggaaaccagatacagaaagcgttatttggatttgatcatgaacaaagacgccagaaaccgttttattacccgttctgaaattatccgttacatcagaagatttttggaccaaagaaagtttattgaagtagaaactccaatgatgaacgttattgctggtggtgctaccgctaagccatttattacccaccataatgaccttgatatggacatgtacatgagaattgctccagaattgttcttgaaacaattggttgtcggtggtttggatcgtgtttacgaaattggtagacaattcagaaatgaaggtatcgatatgacacataatccagaattcaccacttgtgagttttatcaagcctacgctgatgtttatgatttgatggatatgactgaattgatgttttcagaaatggtcaaggagatcactggttcttatattatcaaataccatccggaccctgctgatccagccaaagaactagaattgaacttttctagaccatggaagagaatcaacatgattgaagaattagaaaaggtattcaacgttaagttcccatctggtgatcaattacatacagctgagactggtgaatttttgaaaaagattcttgtcgacaacaaattagaatgtccacctccactaactaatgctcgtatgttagataagcttgtcggtgaattagaagatacatgtatcaacccaactttcatttttggccaccctcaaatgatgtctccattagccaagtactcaagagatcaaccgggtctatgtgagcgtttcgaggtctttgtagctacaaaggaaatttgtaatgcctacactgaattgaacgatccatttgaccaaagggcacgtttcgaagaacaagctagacaaaaggatcaaggtgatgacgaagctcaattagtcgatgaaaccttctgtaatgctctagaatacggtttaccaccaactggtggttggggttgtggtattgatagactggccatgttcttgaccgactccaacaccattagagaagtcttattgttcccaactttgaagcctgatgttttgagagaggaagtcaaaaaggaagaagaaaattaagctaaaagatattagaacatattgtataatgtaagtattattattctaagatagagcttgaatatgaaaactcattacctaaatttgtttatgttcggtagccctaaaggagcttaattaaaaataaaaaaatctaaactattacgtaagggggagaagggataagggatgcaaaaggaaaggcactcaataaattgccctccttattaatgcttgacactgatattaatttcgctttgaagggttgtggatgtgctatacgcttcaaatggatcgtgtttactgcttcgctccaaatcgttttccgaattgtgagctctctgagttttgaaatagcgcctctttccacacttgtaaagttcagcacctatccagaatgcaattgtgaatgcaatggcgagaccccattcagcaccaattggtttatgcaaaaacactttatcattaataaccggaatatagacgacggggaaggctgacacaaatccaaaaatgattgaccagaacaaaaactggtttccccaaatacttctgaaaaattccttgactgggctgtcagtgtctggatgcattctgaaaaaagatcttctcatgtcaaccacttcccaagccagaatcaaagcgcaccacgtcatagttgcgaaagccgcagaacgtgatctataaacatcacgacaactgctgttataggtgccatcacaatcgtgccccaatctaccactatttattccatacagtgatccagtaaatgaagccatacaggaccctgtcattataatcccatatgcaaatgtatctataataacctcccatgtgaaaataccaacctctgaatcattaggaggtctatccatcaaatctggagcagccttttctagacctagccccatagcaggaaaacaagaggtgacgacaataatccacaatacttccactggtgataagggaaatactgattttccgttctcatctctgaatactaaaccaatgatcaaatacaaagcctgagcaacattttctgccaataattgtaggacaaacttctgaatgttatccgtcatcctacgaccttcttcgacagcattcaaaatagaagcaaaattgtcatcgcttagaacaatatcagacgcttctttggaaacatctgaaccattaatacccattgcaataccaacattggccatttttagagatggagaatcgttaacaccgtcacctgtcattgcgcagaacttcttcctacggtgtaaagcttcgatcattctcaccttagtctgcggagagcaacgtgcaataactaaaggtaagacgggcaaatcgtccacttcctcctcacttagtccgtcaaactgagatccggtcatgaccatactgtcaacaatctcttgggagtaatggtacaaattggtgggtaagatgccaacctcctgagcgatagcctttgctgtacccacaaagtccccagttaacatatgaacgttaataccagcttggtgaaacttcttgactgcaccggcagtctcatttctgggtggatcgtaaataccaatcaaccctaggaaaactaaatcactttctgcggtggccctgtttgaagtaatgtttttcaattgatcgtcattcacttgatctttagtgaaagatttggaggcaaaacccaagactcttaaaccctcatttgatagactgtaaacatttttccttatcgtttcgacatcacaatcggtcaatggtgtgatttttacaccatccttaccataccaagaactgcaacaactgatgatgctttcgaaagcacccttgccataaatattatatgtttcgttgtgattgttgtagtagacagatgacattcgcttcacagttgagtcgaatgggaattcagcaatatgttcgaattgtgcactgccaggcttctcattgtgttgtgaaagagaggattggtcattctcattactttgattagtcgatttctcaccggtaagggcattgtgaggcaagtccatcttagtagcaaacacttgaatcgcaatttctgttgggtcaccatgagctttccaacagtcagttgcgtcatctttgaaaacagtagcaatgttagccaaagtggcggtttcgagccatttttgaaatagatccatgtcaatatcttctggtaaatctttttcgtataggcgatccttgaaattctggagaataccaacgtcaccatcctcattatgagaatattcgtaaggtgaaaaccttggaatcaaactcacgttgccctcattgggattaaaggggtcatcagaattcgagatagttatggtaccaaagcgagggatccaaatttgcctcgctaacattttaccctgtgtaagagtaccggtcttgtcagaacagatatcgttaacggcacctaaagcttccagagaatctaattttcttacaataacgtttctagaaaccataacagcagccccaacagacatggtgatggtcaagacaacgactaatgaagagggaatcatggatagggccacacaaatggcatagatagctacccttttatctacgtcaaacttttgagaggccatgacgatgatagcaaaaagtacggcaatccagaaaagcaataccgccaacttagacagtttcctgtgcaggggcgtaccgacatttgtacctaaaaatgcaccagtaactttctttgtagatatccatgtattctgtaaccacgacttactaggatcgcgggaaatgagacctgaatcaccttgtagagattttgcaattttaccaatttcactattcaaagctgtcttgatgacaatacccttggctcttcccttgacaacggcggatgaagaaaatgctaaattcaaacgatcacccacggaggtttcttcttcttttccaaacactaagttggcgtctttggagacaggcaaagattcaccggtcagtagtgattcatcagtatcaaaattcttagtttcaattaaacgcaaatcagcaggaatagtatcaccgaccttcaccagacaaatatcacctggaaccacatcttttgagtttatagtctcacttttcccgttcctaataacatgagcattgggagagctcaagtttttcaaagagttcattgtcttggtagccttatattcttgaactaggccaatgagcacattgaccgcgataacaaaagaaataacgccaccagtaatccagtcgcgcacagcgaaagagatcgccatggatattaccaagaccataatcattgcattacatacctgatggaggaccattgctttatagtcaattttggtatcatcacccaatgtgttctctcccactgctttcagtctgcggagggactcatcttgagtaagaccttcagtcagacttgtgcctataaattcagcggcttcttctgtagtcaatgtgtgataagcattgaattcttcattattgttttctttgacagttccctcgctcatcgaaaattttcaattatgtgtacaaagatttttcctcagtgagtacatacgttatctgataagcaaaatacgaatatgaataacgttgatttggttaacgtattctcgatgtaaaggatgaaggaaaataaaattctttcctctttctttgcctcgagagataatatggagatttaaagaagaaaacatcagcctcacaattacaccgcgcggtgatataaggattttgataaaagaatatatgtgagttgaatttgaacgtcctggaaggaaaagtcttgacgaaataaacgcattaattttctaattctacaagaatttaactaatcctgtattgaaattcataattttagttaagaaccctgtcatacgcgtaacgtaactgtatctgtttcatgatttacaacggcagcaataagagtatagcagtagtattcctctaagacatatttgaactagaaaacatactatttaggcttgtttatgttcagaacctgtgaaaagttcgtttatagtaaataaaaaaacaaataacaaaataaatgtaaatatctaaatatatgaaatgaataaggaaaaagatagggagcacttaataggccctgcctatcattgtttaataccaatattaacttctgtatggattgtagtagaagtactatacgcttcgaatggatcgcgcttattgttactctccaaatcattctccgggttgtgcgctctctgagttttgaaatagcgcctctttccacacttgtaaagttcagcacctatccagaatgcaattgtgaatgcaatggcgagaccccattcagcaccaattggtttatgcaaaaacactttatcattaataaccggaatatagacgacggggaaggctgacacaaatccaaaaatgattgaccagaacaaaaactggtttccccaaatacttctgaaaaattccttgactgggctgtcagtgtctggatgcattctgaaaaaggatcttctcatgtcaaccacttcccaagccagaatcaaagcgcaccacgtcatggttgcgaaagccgcagaacgtgatctataaacatcacgacaactgctgttataggtgccatcacaatcgtgccccaatctaccactatttattccatacagtgatccagtaaatgaagccatacaggaccctgtcattataatcccatatgcaaatgtatctataataacctcccacgtgaaaataccaacctctgaatcatgaggaggtctatccatcaaatctggagcagccttttctagacctagccccatagcaggaaaacaagaggtgacgacaataatccacaatacttccactggtgataagggaaatactgattttccgttctcatctctgaatactaaaccaatgatcaaatacaaagcctgagcaacattttctgccaataattgtaggacaaacttctgaatgttatccgtcatcctacgaccttcttcgacagcattcaaaatagaagcaaaattgtcatcgcttagaacaatatcagacgcttctttggaaacatctgaaccattaatacccattgcaataccaacattggccatttttagagatggagaatcgttaacaccgtcacctgtcattgcgcagaacttcttcctacggtgtaaagcttcgatcattctcaccttagtctgcggagagcaacgtgcaataactaaaggtaagacgggcaaatcgtccacttcctcctcacttagtccgtcaaactgagatccggtcatgaccatactgtcaacaatctcttgggagtaatggtacaaattggtgggtaagatgccaacctcctgagcgatagcctttgctgtacccacaaagtccccagttaacatatgaacgttaataccagcttggtgaaacttcttgactgcaccggcagtctcatttctgggtggatcgtaaataccaatcaaccctaggaaaactaaatcactttctgcggtggccctgtttgaagtaatgtttttcaattgatcgtcattcacttgatctttagtgaaagatttggaggcaaaacccaagactcttaaaccctcatttgatagactgtaaacatttttccttatcgtttcgacatcacaatcggtcaatggtgtgatttttacaccatccttaccataccaagaactgcaacaactgatgatgctttcgaaagcacccttgccataaatattatatgtttcgttgtgattgttgtagtagacagatgacattcgcttcacagttgagtcgaatgggaattcagcaatatgttcgaattgtgcactgccaggcttctcattgtgttgtgaaagagaggattggtcattctcattactttgattagtcgatttctcaccggtaagggcattgtgaggcaagtccatcttagtagcaaacacttgaatcgcaatttctgttgggtcaccatgagctttccaacagtcagttgcgtcatctttgaaaacagtagcaatgttagccaaagtggcggtttcgagccatttttgaaatagatccatgtcaatatcttctggtaaatctttttcgtataggcgatccttgaaattctggagaataccaacgtcaccatcctcattatgagaatattcgtaaggtgaaaaccttggaatcaaactcacgttgccctcattgggattaaaggggtcatcagaattcgagatagttatggtaccaaagcgagggatccaaatttgcctcgctaacattttaccctgtgtaagagtaccggtcttgtcagaacagatatcgttaacggcacctaaagcttccagagaatctaattttcttacaataacgtttctagaaaccataacagcagccccaacagacatggtgatggtcaagacaacgactaatgaagagggaatcatggatagggccacacaaatggcatagatagctacccttttatctacgtcaaacttttgagaggccatgacgatgatagcaaaaagtacggcaatccagaaaagcaataccgccaacttagacagtttcctgtgcaggggcgtaccgacatttgtacctaaaaatgcaccagtaactttctttgtagatatccatgtattctgtaaccacgacttactaggatcgcgggaaatgagacctgaatcaccttgtagagattttgcaattttaccaatttcactattcaaagctgtcttgatgacaatacccttggctcttcccttgacaacggcggatgaagaaaatgctaaattcaaacgatcacccacggaggtttcttcttcttttccaaacactaagttggcgtctttggagacaggcaaagattcaccggtcagtagtgattcatcagtatcaaaattcttagtttcaattaaacgcaaatcagcaggaatagtatcaccgaccttcaccagacaaatatcacctggaaccacatcttttgagtttatagtctcacttttcccgttcctaataacatgagcattgggagagctcaagtttttcaaagagttcattgtcttggtagccttatattcttgaactaggccaatgagcacattgaccgcgataacaaaagaaataacgccaccagtaatccagtcgcgcacagcgaaagagatcgccatggatattaccaagaccataatcattgcattacatacctgatggaggaccattgctttatagtcaattttggtatcatcacccaatgtgttctctcccactgctttcagtctgcggagggactcatcttgagtaagaccttcagtcagacttgtgcctataaattcagcggcttcttctgtagtcaatgtgtgataagcattgaattcttcattattgttttctttgacagttccctcgctcatcgaaaattttcaattatgtgtacaaagatttttcctcagtgagtacatacgttatctgataagcaaaatacgaatatgaataacgttgatttggttaacgtattctcgatgtaaaggatgaaggaaaataaaattctttcctctttctttgcctcgagagataatatggagatttaaagaagaaaacatcagcctcacaattacaccgcgcggtgatataaggattttgataaaagaatatatgtgagttgaatttgaacgtcctggaaggaaaagtcttgacgaaataaacgcattaattttctaattctacaagaatttaactaatcctgtattgaaattcataattttagttaagaaccctgtcatacgcgtaacgtaactgtatctgtttcatgatttacaacggcagcaataagagtatagcagtagtattcctctaagacatatttgaactagaaaacatactatttaggcttgtttatgttcagaacctgtgaaaagttcgtttatagtaaataaaaaaacaaataacaaaataaatgtaaatatctaaatatatgaaatgaataaggaaaaagatagggagcacttaataggccctgcctatcattgtttaataccaatattaacttctgtatggattgtagtagaagtactatacgcttcgaatggatcgcgcttattgttactctccaaatcattctccgggttgtgcgctctctgagttttgaaatagcgcctctttccacacttgtaaagttcagcacctatccagaatgcaattgtgaatgcaatggcgagaccccattcagcaccaattggtttatgcaaaaacactttatcattaataaccggaatatagacgacggggaaggctgacacaaatccaaaaatgattgaccagaacaaaaactggtttccccaaatgcttctgaaaaattccttgactgggctgtcagtgtctggatgcattctgaaaaaggatcttctcatgtcaaccacttcccaagccagaatcaaagcgcaccacgtcatggttgcgaaagccgcagaacgtgatctataaacatcacgacaactgctgttataggtgccatcacaatcgtgccccaatctaccactatttattccatacagtgatccagtaaatgaagccatacaggaccctgtcattataatcccatatgcaaatgtatctataataacctcccacgtgaaaataccaacctctgaatcatgaggaggtctatccatcaaatctggagcagccttttctagacctagccccatagcaggaaaacaagaggtgacgacaataatccacaatacttccactggtgataagggaaatactgattttccgttctcatctctgaatactaaaccaatgatcaaatacaaagcctgagcaacattttctgccaataattgtaggacaaacttctgaatgttatccgtcatcctacgaccttcttcgacagcattcaaaatagaagcaaaattgtcatcgcttagaacaatatcagacgcttctttggaaacatctgaaccattaatacccattgcaataccaacattggccatttttagagatggagaatcgttaacaccgtcacctgtcattgtgcagaacttcttcctacggtgtaaagcttcgatcattctcaccttagtctgcggagagcaacgtgcaataactaaaggtaagacgggcaaatcgtccacttcctcctcacttagtccgtcaaactgagatccggtcatgaccatactgtcaacaatctcttgggagtaatggtacaaattggtgggtaagatgccaacctcctgagcgatagcctttgctgtacccacaaagtccccagttaacatatgaacgttaataccagcttggtgaaacttcttgactgcaccggcagtctcatttctgggtggatcgtaaataccaatcaaccctaggaaaactaaatcactttctgcggtggccctgtttgaagtaatgtttttcaattgatcgtcattcacttgatctttagtgaaagatttggaggcaaaacccaagactcttaaaccctcatttgatagactgtaaacatttttccttatcgtttcgacatcacaatcggtcaatggtgtgatttttacaccatccttaccataccaagaactgcaacaactgatgatgctttcgaaagcacccttgccataaatattatatgtttcgttgtgattgttgtagtagacagatgacattcgcttcacagttgagtcgaatgggaattcagcaatatgttcgaattgtgcactgccaggcttctcattgtgttgtgaaagagaggattggtcattctcattactttgattagtcgatttctcaccggtaagggcattgtgaggcaagtccatcttagtagcaaacacttgaatcgcaatttctgttgggtcaccatgagctttccaacagtcagttgcgtcatctttgaaaacagtagcaatgttagccaaagtggcggtttcgagccatttttgaaatagatccatgtcaatatcttctggtaaatctttttcgtataggcgatccttgaaattctggagaataccaacgtcaccatcctcattatgagaatattcgtaaggtgaaaaccttggaatcaaactcacgttgccctcattgggattaaaggggtcatcagaattcgagatagttatggtaccaaagcgagggatccaaatttgcctcgctaacattttaccctgtgtaagagtaccggtcttgtcagaacagatatcgttaacggcacctaaagcttccagagaatctaattttcttacaataacgtttctagaaaccataacagcagccccaacagacatggtgatggtcaagacaacgactaatgaagagggaatcatggatagggccacacaaatggcatagatagctacccttttatctacgtcaaacttttgagaggccatgacgatgatagcaaaaagtacggcaatccagaaaagcaataccgccaacttagacagtttcctgtgcaggggcgtaccgacatttgtacctaaaaatgcaccagtaactttctttgtagatatccatgtattctgtaaccacgacttactaggatcgcgggaaatgagacctgaatcaccttgtagagattttgcaattttaccaatttcactattcaaagctgtcttgatgacaatacccttggctcttcccttgacaacggcggatgaagaaaatgctaaattcaaacgatcacccacggaggtttcttcttcttttccaaacactaagttggcgtctttggagacaggcaaagattcaccggtcagtagtgattcatcagtatcaaaattcttagtttcaattaaacgcaaatcagcaggaatagtatcaccgaccttcaccagacaaatatcacctggaaccacatcttttgagtttatagtctcacttttcccgttcctaataacatgagcattgggagagctcaagtttttcaaagagttcattgtcttggtagccttatattcttgaactaggccaatgagcacattgaccgcgataacaaaagaaataacgccaccagtaatccaatcatgcatggcaaacgagattatcatggatattagaaggaccatgatcatggcattacatacctgatggaggaccattgccttgtaatcaattttagtgtcatcacccaatgtgttctcacccactgttttcaatctgtggacgaactcatcttgggtcaaaccttcagttagacttgtgcctatgaattcagcggcttcttctgcagtcagcgtgtgataagcattgaattctgcattattgttttccttagtagttccttcgcccatcgaaaattttcaattctgtgtacgaagttttttctttaattagtaaatatacgtattgttgcctcaaataaatgtgaattaagtgtgaacagttcacttgatgaagatatctgctttattaaagttaatattagaatataaatgattagactattactaatgagaaaagaaagataggagaaatagtagaaattaatagtactctaaaaagaaagaacggaataagaggaaaagaccttttatctattcaaattgtttcccttaggtatatatatatatatatatatatatatatattttccctgtatatatctatgtaaatgacgaaaacgcatgacattttaaaacctaccccgggtttgaccacaacccaccgttcatctaatattaacccgcacccaccaaggaaagaggcaataattcgggaatactgctctaagaccttgttttttcttctgtcaggtgaaagtatatgaccaaaatctacatccctgccctaacaaacgtcatagaagtaggaaataaatgatgagccccgcaaaatgacgccgcacggcgatgtttaagaccctgtactcacaatgtaaccacttcgtgcagaagcttctgggaggaaagggtccgtacatgaattatcacacccacacccctcattcaatccttctaccgcgcatggtaatcaatcataacaggaagcgataagaaagtttacattgcacagccaccctcattgcctctgtgattgaagatctgggagtggggctaaaggtgcaacttccgtacaagagtgacgagataaaggattttccacggaatggctgacaaaattcggggcttgtgtgagttccacgtgcggatgacttaataagctcagtgattgtacttttgacatgattgatgaacggctagagatagccaccgagtggctacttagtaataaccagcgtaggaaacaattacggattttgttatcgttcaccgataaccctaaaatattgaccacactggtagtcattagaatttaaccaagagggtagcttagttcgaccgataatcaatattactgaagtcttatcaaattctgactcttgccataccgtttcttatcgtcactgtttaatccggaaattagtcatgtatccacacatcctttattaacagcagagagattgggcaagaatgttagcaaactatgtaccaggcgggtaatacctgtacatctattttcttttgaaaaggaaaaaatgcaagaaagggcatgaaatgaaactatttggtacaaattagaattatgcgaaccgtgcaaaatcagaaaagggggaaaaacattggccaatgcttagaaataccattgcattaagatcatttatcagaacacagtcgacgcgcccatatcctgtaaatgtagaggcagtctactatgctcctttaaagttacctatcaaatatggtgatttagttgcagacattcagttaagatcgtatgacaatgaaaacctcgatttttattcagacttcatacttagaacaggttactatttgggtatcccattgacaggtcctaaacctttgcccacgagaagagaaaggtggactgtaataaaatcacctttcgtgcacgctaaatccaaagagaattttgaaagacatacacataagaggctcattagggcctgggatacgaaccccgaagtgctacagatgttgatagcttacattacgaagcactctatggcaggcgtcggaatgaaatgtaacttctttcaaaggtccgaaatatcgctggacttgggttcggacgccaatggcctcgaaaaatcactaagcaatatcgatgaattgtattctctgagaaacgatgataaagctcaaactagtgctgtcggacaaaaagtattggaactattggatagccccgattttaaaaaacatttggaaaagaagtaaaaagatgatggcaatcctataattacgctggttcttgggaccgaaaagatttcgtacttgtaaataaaataggtgaagaagaggggcaaaaagtagtagattaaatggttatactgaatttataagtaagtttaattatattttttaactatatgatgaacaattttgtactaatattgcggcccgttatgagtattgctcttgccataaaagtgtgttcactgctttgtttcctggtactgcataccgcttaatattgttatcgctcaataaatttagtttctggaagctttccaaggacttaccaggtagcgggcctgagaatctattttttagtccatcggctacaaaaatcggtagtatatttgttcttggtaagtaagctttgctaaaggaaagtgtcctttttctgtttgtattcttcttcgaattccacctgaaatgttggacattcagggatgtgtgtaaccgatacttctggtcagagagtttgtatacaatatactccgctaatctgaaaatggtaaaaaataatataaaaacattcttggtagcagatatggaatctgaattcatattgagaaagtttcgctcagtactccaactactttcgagcagagtagtggaatcagattccattattgaggctttcgttccgaataattgtataactgggttataaaatagttgttggaaaatagaaaaaatgaggacctttagaaactttaaaccttgaaaagtagaaagggtagaaattttaaggctttgattatataatatttgctccatgttgtgaaaagaaaaagattttttctcttagagacctagtcgtttgttagctgttgttgattcgctattttcaatagtaaagtttctaataaaatgacaaacatgaagaagatataagtgcgtgttcttccaatatataatatttgtactgcagatacacagattcaaatttttccctgttatccgcctttcttcttggaaattggtaacaggattttgtgtcattagcaaaaataatagccattagtaagtacgctttgttatcccgacgcgaaacagaaacagaaataaagaaaatgaaagctactctgatttacgttaccgccattgaagatggaggatgaagcacaataagaataagaaaaaagaaaatcagcaagaatgacgcgaaaatatattatcagtgttaaaaagctattgtcaaagtttgtttccacctataaaggattcggacgaagaaattcatgttgttgttgttataggatatcatcatatatattttcgatcactcgccaagagaatgtataataaggaaaaagataccacgttcttctgaacatgttcaatatcctttctcctactttgctcagtacttgagccccatgcgtttacatgatttcaaaagatatggagctgaagccttttgtcttggccgaggatatggcaccttttatatgaccgtatggaagacgtagagtggatgaaaattttgtgaaaaaaaaaagcttataggaacaaaaacatccttacatcttcgggtatttcttctagggttgaagtataataattaactatactattgttcggagacagttctgatgcctagtaaaaacgcttgcagctctaaaaaaatttgtcttatttttttcttcttcaatgagctgttaccattgctgtaagagatgctcgaaaggtagtaccttcagtgaattatctgacgtacatcacgtgaactgttttgcgtagtaaattgttcaacgataatatatcgttgttagtgatcaaaaagtaactatgcaaactgcaaatgtcaaaaagccacagtttctaaaagaaaagcaatgaatgaagaaggtttggggttgtaaatgttaatgcagcgacgtctgtttttttgttatgacaggaagtcaggaggtagtcacagtctcgtattaagcaaaagtggtctgtttaggtggcataatagccttgttgcagcactacttgctaccgaggcgcagccttacaactaaaatgtccagacatgatcttaagcggaagggaggggtttttgcttccgtttttttgacattaaaagttttcttaatgccgcgcgtttgaaaggaaactgatctgaaagtgatttatgatgccaaaaaaaaaaaaaaatcttttgaagtacaatgtatgtatgcatgagtttataaaaaatgatgtaaagtgcggaatagtagtactgctaatgagaaaaacacgggtataccgtcaattattgtccctttttcaaatgtgttctatagtgttgcaagcaattatcatgtcgactgaatcgctgcgtgcatcccttatacggacaacaatgatttttttcgcccgtatgaattctattatgccttgctaaatgacccgatgtagtgaatcctcttgcgcaaattttgcaaatgtatttgcgcctttgttcaaggtcttcctcatctgataacgtatttcttggatctgttctttgcttccgcgttttcagagagtatctactatttgccatcttattatatgcatcattagaaactattccgttctcaggctgttgtattattgatgaattacaagttagttgtgatagcgagcttttttcggatgaatctgaattatattgtaccgatgaattgtcaaaagagacgcttcttgtttgtaaattaggcgttattaagtattttggctcccacttttcagagccattttctgatttggtttggtatcggaaatcaaaagcagtcttatttaatttgtgttttagttcattctctaccacatgagaattagttagaactggtagtagcgtctgatattttctttccgggcttatttcaacgttttcttcatcttgcattccatcaaatgcggagattcccggcagtgcgggcatagtagaaacattgaggttactatagttatatgggtaaaacattgcctgaaagtttgcgaagggtagtaatatgctggtcgagaggaacaatccaagaaaggtgaatggtagaaaaaggcgccgtaatggtaggaattacagtacaataatactttgcagaatcgtatacgatatgatttttactttcaaaagctgcagaattcccttatagcatcaaaaaactgtaaacgaggtggagtaatataatttcttttagttaagagatgggaaccaaattttttttaatttgggtttggaaagttctcttccttatatatgaataacggaaaaggagcctgcagccagactgtagaaagatgacactgccaagagaataattaaaagaaaaaacaccccaaacaccctgaccggcggcgaagcccctctgcgcgctcaacgcgtttcgtttcacgcttaagggtcctcaagaggccatagtcttttaccgataagaaaaatctagacccaatgaatttttcccttcttttccggtgcggccttttcactgctaaacagtaaaaagcatttcttggctttccctgagggtgttgaccgcaaccaagccaatacttcattttgctttttcctcttttagaaaacagagttttccctgtctcaaacgtttcaaagacaaatatgcggaaaatcaacttataagtagaaaaatactagcgatttttctagttagaatatttaggggaactatgcgaagacaaacggtgaagtcaaaagaaacacactgcctcgattagaaaggcttatctgccacagtttaatttttttttaattttatttcttttttttttatttaactagaatctggctaaaaataagcaacggtccgtgtagattactgtttcgaacgaggaacaactgaaggaaaagttttttattttccgcgaagttcgtatattttagttttcttttactccaagggttcgtgacgtcgaattcctatcagcttttttttgcgcttggcgttctaggtccctgtgcccgtctgaaactattcgtacatagcattactagagtacataatatcgtctaccatacatacgacgggtagccagattttgtgccggattgtcggggaaaagacggcaaatgagctcatacgtaatggtgcgattttgattcttagctttctatttctggagaaaagtactccaaggtggggaaggggggaggctgggactagttgttatatgatgtagcctaaatgtaacgaggcgtggctctttcatcttatctcaatgaataagtgtaaattgcctcgcctggtttaatcttttctccacatgcagtaataggtataaaaggagttgaaattaaaaataataataaataatgatataaaaattataagtttctcctttcggaactaaaaaataatattaataataatatataaatattatatcttttttataatataacatagatacgagtttttatgttcctttggcaatagcttttcgtgacttgttttaaatacaaggcatataggcgcagcttcaccaagatattctggcttaaaccagcactatgtatattttggtgtttgataccgatatcggcagctcgaagcgtttttatgaactgtaaaaatatgtcctacatagttgtttggtaattttttggttttttaagattgttttatgaataggtgttttaccagaaggctatcgccaggtaactcttttaactaaatcgaaaagatttatttgacgtgtcatattgtaaaaactaaatggaagacagaaactaactttgtcgacacctattttaaacaagtatcaaacgcgggctataatttttatgagagcaatcaatgcaatggagtctatttccggttaaatggcacgattgtgcgtaaaaacacgagaaagtggaagcatctttttcttaatgacggataattacccgaaacagtgcaactgcaagtgcatactcttgaaggacttacatattgagagggaacacattactacctttcaagaacactcgcatttacggcgtacatatggttccgcggtagaccctaggttgaattgaaaaccatgttttgaaggaaagcaaaggcagaatgagaacatggagatgtaaatattttcccagttaggcatgacccaaaatcgcaatccagatgcaatttattatgacacgtagacctttccgtatctaacgtaataaacgatatctattttcgaggcgctcgacatctcgtatctgggacagaaagtgaggtagattattcaagaatacctattaagaaaggtagaaggtattgcaccgattcctagtatcaattcttttcaaaaccacttattttgcaaaacatgcgtctaacctgccatttcagcaacgtaaataataattacttccatatatattcttctcccccagtagcaattttgacatgacaaatttcagcgatagttgcttcggcattcgaaaatcgtagaagtatgtcttaatgtagaaggttgagaacaaccggatcttgcggtcatttttcttttcgaggaaagtgcaagtctgccactttccagaaggcatagccttgcccttttgttgatatttctccccaccgtaattgttgcattcgcgatcttttcaacaatacattttatcatcaagcccgcaaatcctctggagtttgtcctctcgttcactgttgggaaaaacaatacgcctaattcgtgattaagattcttcaaaccatttcctgcggagtttttactgtgtgttgaacggttcacagcgtaaaaaaaagttactataggcacggtattttaatttcaattgtttagaaagtgccttcacaccattagcccctgggattaccgtcataggcactttctgctgagctcctgcgagatttctgcgctgaaagagtaaaagaaatctttcacagcggctccgcgggcccttctacttttaaacgagtcgcaggaacagaagccaaatttcaaagaacgctacgctttcgccttttctggttctcccaccaataacgctccagcttgaacaaagcataagactgcaaccaaagcgctgacggacgatccgaagataaagcttgctttgcccattgttctcgtttcgaaaggctatataaggacacggattttcctttttttttccacctattgtctttctttgttaagcttttattctccgggttttctttttttgagcatatcaaaagctttcttttcgcaaatcaaacatagcaaaccgaactcttcgaacacaattaaatacacataaagatgcctgcccctcaagatccaaggaatcttccaattagacaacaaatggaagctcttatccgtcgcaaacaagctgaaatcacgcaaggtttggaatccatcgatactgttaagttccacgctgatacttggacccgtggtaacgatggtggtggtggtacctctatggttatccaagacggtacaactttcgaaaaaggtggtgttaatgtctccgttgtttatggtcaattgagcccagcggccgtttcagccatgaaagctgatcataagaatctgcgtctaccagaagatccaaagactggtttgccagttaccgacggtgtcaagttcttcgcttgtggtttaagtatggtcattcatcccgttaacccacacgctccaaccacgcacttaaactaccgttacttcgaaacttggaaccaagatgggaccccacaaacttggtggtttggtggtggtgctgatttgacaccttcttacttatacgaagaagacggtcaattattccaccaactgcacaaggatgccttggacaagcacgacactgctttgtacccacgtttcaagaaatggtgtgatgagtacttctacattacccaccgtaaggaaacacgtggtattggtggtatattctttgacgattatgatgaacgtgacccacaagaaatattgaagatggttgaagactgtttcgatgctttcttgccatcctacttgactatcgtcaagagaagaaaagatatgccatatacaaaggaagaacaacaatggcaggccattagacgtggtagatacgttgaattcaacttaatctacgatagaggtacccaattcggtttgagaaccccaggctctagagttgagtcaattttgatgagtttgcctgaacatgcttcatggttatacaaccaccaccctgctcctggttccagagaagctaaattactagaagttaccaccaaaccaagagagtgggttaaataattcaaggttctttagcagaccgattttatgatctcaatgacaatgatgatttaattatttcgaccacttatttatacatttttttatctatttattatacctcctttacataattcttcaaattcaattgatacaggatctctattcttaaaaatattaattattgcgtcctatttatgatgcaagttcacagtacgtgcaggatcaaaaattatatcagtatctattgctctaaaaatatggcagcagccttcattctcaatatgcgatcatgccttctaatcaaattttaagatgtttttattactctttttattcttagaaaattcatcttatattcaaggacttcttaattttccttccatctatgaccacagtttacacacttataaaaggtagtcatcggctcatcagctgacctaatttgtagttggaaaaagtaagcactctcaccaccacaagtatcataattgggacattgggttttggtttgatccacattgtcccaaccaccaccaagaacatcatcaacttcctttcttggaagtttcttcctatcatagatttctataccctctataggaaactcatatggacatgaacggcatgctaatgtatatacaccactatcgccactcgttatcagtagcatattgttacacgaaggacaaaacgaaagcatcctaaattatgtattttacgttttaccaatgaatgcgaactcttttgcttatatagccatataacgtatgcgttttccagaaagaagattctcggttatgcttttggataaaacttttcctactgttcttttgaactggatttgaattttatatcgatcatcttgccatgtaataatagatgtccaaaaatttcatctgccatttttttattttcccgttcgttcacttgctctagtttttttttttttttttttcaatactcggatttgaaaatgttaatgggagtggcgctaaaaaccttcatctgtagttgaatgctatgacatgagcaacacaaaatcatttagacaacgttgagtaaggtggttcggtccgaacaacagtttcatgcttgtgttacttcgtttatgaatataatatacaaatatttaaaatgctatttattatgcactaacaccaaaatttgtagactctgacgaatattgaagagttctttaacctttctttattttcttcgtcctcctgcctcattatttcagggtcgtaaactcttctatgaaagtccaagtcgatcttgtccagtgggtttaaaaaggtaaaatctcttttgtaaaccatgtatccaacatacatgaatatccatagcggggcagccagataactctcgaagaatgcctgagcatcacactttccgccatttcctattggagacagtgcgacccaaaattgggccataaagacaagcatattgaaaaaaaccccatagtatgaaccccatataccggtattggccttatagccgacttcatcaagtgatcttccttggactttcatcgcttttctgaatcgaatgtgtgaaagcataatgcctgaccatgtgaaaagttcactcaaacctgcaatggctgccaaccatgtaaatgcttgctcttcctgtggagaacaggcgacgaagccaacgacaccaacaagagagcacactaccaaggcccttaaaggtcttccctccctatcaatatagttcaaaaattttggagcatagccctgttgagccaaggaacacattaatctcggtgcggcataaagggcagagttcgcaacagagatgactgatatcaaaataacagcattaatgatatgggggatgaccctaaccttgtgaatagaggctgccaagacatatggtgaagcgtgcgttgcggagccaccggaacccatcaattgatcgttattgtgaggaacattgaacccaattagaatcattgtcagcaaataaatgatcaaaatacgatatacacttctcttcgcggctacaggagtggattttctagggttagactgctcattgatggaaagaacaaataattcaataccaccgaaggagaaatatgcagatactagaatataacatatccctttgaaacgagtggcaccgctgccttctgcaaatgaaccagggtcgcgccaatatttgccgccaatatagccgtccacaccggctcccccacaattgatgacgactgataaaataatgaatcctgcaaccatcaatatcttacaggaattgaagataaattccgtttcaccgtatgccttaacaccaaaaaagtggataaacaataaaaacacatagaaaatgacaatgaatacatcagcattaattgtgtcattccagtacttgacggtcatggaagaagtaatcaattccaacggtagcacagttaaccactgaatgcaaaataaccaagtggtcgcgaacccaaacgactttgaaataaagattgaattgtatgcattgaagttacctggaagcgtcggataagtgacacccatctcaccagccgcttggaccataaaatacgtgacgaaggacaccataacgtaaccgatgactaaagaccccgggcctgcaagactcaaacctttggcgttggcaactagaagacctgttcctatccctgtacctaaagacatcattacaacatgtctagatttcattgacttttttaagtggttattagatttcatcgatttggtaccatcctccaagtcattgtcttcttctaaacgttggctttcggctcttctgaatgagtcgacgaatctgtgaactaacccattgcgagattcctcagaatgttccttaatctccggagttagtgaagctgttgttgatgtattgaagttattatataaagcagagtctgttacttcaaactctgcacttttttccattttggaagacgttactataggatctgacattaccttaggggaaagaaaatattaagaaacaatatcttacttcgccaatccatcaatagtaaccacgctaattacaacgtagtttttaatgcccggtttttccgatttaccacaaggaaacgcaagaacaaactacatactgccactgaaatgaatttcactgctaatatatctatcctttagcgaaaaagacaagatcaacagaggcgccagaaaaaggcaattatgactaaaaaaaaaactgtgtaaacctggggatggtagctgaactacttgcagtcgaaaatgaccgcatattttactgtcatgcttctgtcaagaaaaacgagccttggatgagagctttcgttgatcgcggctcgaagttcaggtagagaaatatagcagagctcttttcgcggagccgcatgcacggctacattaaaaggtgtccttccagctcagcgatatgtgtcggccggaaaaaaaaagcacgcatccggcaagcacactagtaagtctaatgcaggatgaagaaacgaagaaggtgccatgagaaggaaaataaaactcaatgggacggaacggcagcattttttaacaaattattttggattcatccgtaacaatataacttggtacgggaacggcatgttttaaatgcacagcggtgccttgtttcgccgtggattgttaaaggctctttttcggacgccacatattcctatgctgcaccagcaattggtgtcttcggatcatactacttcgcactagtttatattcaaggcttttaatggagcttcgctcttaaaagaaaaaacttctttacttccatgcgcgcgtttttggcgtacgtagcactgcgaaagagtgggtgatatatagagaacatgttgtagtatacgtacgcgggcaattgtggtgacagtatctctttctgttagcaagtaatatatccttggcctcaacctgtcaatagtgttagtttatccgccatcttggcgctatcatacacgatctttttcaatgtttctcgtatatacaggacagggttcggggtttttggcggcaggagaggaaagcaaaaaaaaatgaggcaagagttttaattttgccagcgaaatgttctgccattttcatctttaccgctcgaattagtgatgttccagacgaaggtaacatagagtgatcgataggttcttcaattcatcaagcattatctcagaattgtgtttggtaagctctcttcgagaaaaggaagaacaaaaaaaaaaaaaataaagcaaagaacaggttataacgctatgggtaactttccagctccaaaaaacgatttgatattgagagccgcaaagggtgaaaaagtcgagagaccgccatgctggataatgcgccaggcaggtcgttacctgccggaatatcacgaggtgaaaaacaatcgtgatttctttcaaacttgcagggatgcggaaattgcttctgagattactatccagccggtaagacgctatagaggcctcattgatgctgctattatttttagtgatatcttagttattccgcaagccatgggtatgagggtcgagatgctcgaaggtaaaggtccacatttcccagaacctttaagaaatccggaagacctccaaacggtattagactacaaggttgatgttttgaaagagttagattgggctttcaaggcaatcaccatgacaaggatcaagttggatggtgaggttcccttatttggcttttgcgggggaccttggactctaatggtttatatgacggaaggcggtggatcccgtcttttcagatttgccaaacaatggattaacatgtatccagagctttctcacaaattattacaaaaaatcactgatgtggccgtggagtttctgagtcagcaagtcgtggcgggtgctcaaatactacaagtttttgaaagttggggtggtgagctttcgtctgtagattttgatgagttttccctaccatatttaagacaaattgccgaaagagtgcctaaaagattgcaagaattaggtatcatggaacagattcctatgatcgtttttgcgaaagggtcgtggtatgctttggacaagctatgctgttcaggatttgacgttgtttcgttggactggtcctgggacccaagagaagcggtaaaaataaacaagaaccgtgtcaccttgcagggcaacctggatcctggcgtcatgtatggttctaaagaggtaataacaaagaaagttaaacagatgattgaggcttttggaggtgggaagtcccgctacattgttaatttcggtcacggtacccaccctttcatggatccagacgtcatcaagtttttcttggaggagtgccacagaattggttcgaagtaatgtggaaatattgattcttatagtgttataagtgataatatacgtttatgtaaataatatctttttcacaacgttcaaaagtggccttttttcttttttcgatattctgtatatttattacgatttttttttttttcagatatttatttttgcaggttctctgaatggatgtagtgacaaaatcttaaatagaagaaaataaaagatgaaggtatatgaaaataaatgagaatgcatatcacctttccttcgaagaaaaaggattttcaaaagatctgcacgcctgttgacaagcttccaatagcatgaattcacaaaaggcgagtaaaatgactggctcactaaaaaagaatgatctttatatttttgatttgtctgagcaacttctgaattcattgaaattgatgagctttgactccacactgcgagaagttgaagtagagaagacatctgataatgatagaaacaaggagtctggagatctccaaatagcaagaaagaaggtcacatcaaatgttatgcgttgtagtgtttgtcaaatgagctttgattccagaaatgaacaaaaggcccactaccagactgattatcatttgatgaatgttaagcgtaaccttagggggctggatatcctatccgttgaggaattcgatgcgctgatttctaaggagcatggtatcaagtctgaagacgaaaattctggcggcgagcaaacttcaagcgatcacgaagaaagtgaggaagccagcgatcgggacccggacctacaaactaataattatatggaaactataatcgaaaatgatttgcagaaattagggttccaaaaagacgagtcggatgctattagccatattaatacccaatcgccctacatttatttcaaatcgaagtatcttcaaaagaatgaggtcttggcgatttataagtctctatttaataaaaggagtctttccaaccccaatgaagctttgactttttggaattcgcaagagaacccaatggccatttcagctctgtttatggtgggaggtggacattttgcgggagcaattgtttctcatcaaagactcaatgtcaaggggaacgcgcacaagaaggacgaaaccttaattgagcaagcggtcaatttcttagagcacaagacgtttcacaggtatactaccagaaggaagcaaggtggttctcagtcagcaatggacaatgcaaagggaaaagctaactctgccggttcagcacttcgtaggtacaatgaaagcgctttaaaaacagatatacagggtgtgttgaaggactgggaaccttatctgtcaaagtgtgataatatttttattcgagctcgcaatgtcagtgataaaaaaatttttactgataataccgttctgaacaagggtgatgaaaggataaagagcttcccttttaccacgaacaggcccactgtattagaattgaagaaggcatggtgcgaactttcctacctgaaaatattacctaagcctgaaccattggcagtgaaagaaacagtacaaaagttagaagtgtcgaacaaaaaggacgaatttaaagaaaaacaagaaccgttactggaagaaatccaaacagaagaaataatttctctgctgaagaaaggaagggcaccgttattgatatccttcttaaaaaagaataagcttgatggaaactttcggttaaagcctgagagtaaatattccttaacccctaccatgttacattatgcatcgcagcaagggatgaaacagatggcactgattttgctctcaaatattaaatgcgatccaacgatcaagaacagactaggaaggactgcgtgggatttgaatagaaacgacgacgtgagacacgcgtttcaaattgcaagatacaatcttggagagtctttcactaattgggacgaaactcatatcggtcagccattgagcagagaacaagttgatgaaatcaatgaaaagaaaaaagcaatagagaatgaaaaggcagaaaaactgattaaattggaattagaagccgccaaggaaaaacaaagatttgctaaagatgcagagaggggtccaggcaaaaagttaaccaatattccttcaattcagcaacaaaatttgaattctttgaccgatgaacagagacgcagattgatgagagaacaaagggctagagccgcagaagaaaggatgaaaaagaaatactgaggaatatctcatattcaaatttttaggatttttcttagcatttgcatatattttcatagacacagtacttacatttaataacagtaattgaaaagcaatattaaaatatagaagcccaaattttatatttcaaatgaataaatgttgttttttttggcaattttttgctcttctatataacagttgaaatttggataagaacatcttctcaacgcgaaaatgacgcctccagtgaaaaaacataaactttcaatgcagtcttcggtacacttatgagtaacccatatagagatcgtacacattttacaaggatttagagacaaagtaatattcttcgttgatatagaggtgttcaattgttaaatgcttttcttctttttattagaaaaagcgccttgctttttgttgtatcacttgtaaatctaccgtcccttacaagaacattcacgaaatttaagtggctcagaatgaaaaagaaacaatataaaaaagctttccgtagtcatcaatttattttacataacactagatataaagaaaagaagataatatttttatataattatattaatcttagtttctagagttgatgatatcaacaaattctggcttcaaagaagcaccaccgaccaagaaaccatcgacatcagccttgtccttgaaggtaacggcgttgctaccgttagcggaaccaccgtataagattctcaattcgctggcagccttgtcacccaacttggaagccaagaactttctgatggaagcgtgaatatcttgagcatcttctggagtagcagccaaaccggtaccaatggcccagactggttcgtaagcgacaacgacgttagtccagtccttaacttcttccaagacagcgttcaattgtctttcaacaacatccaaagtcttaccggccttcttttcttccaaagtttcaccgatacacaagatgacaccgacaccttgacctaaagcgaacttggtcttgtcagcaatgaacttgtcatcttcgtggaagtaagatcttctttcggagtgacccaaaataacccacttagcaccaacatccttgatttggtcaacggagttttcaccggtgaaagcaccagaagccttcaagtaggcgttttgagcaccgacagtgacttgtggcttcttaaccaaagagacagagtagtctaagtaggtagctggaggacagataacaacttcgacattttctgggatagaagcagtgttcaatctttcaacaatttccttaatggattgtttggaaccgtttaatttaaagttaccaccgacaaagaaagttctagccatttttagtttatgtatgtgttttttgtagttatagatttaagcaagaaaagaatacaaacaaaaaattgaaaaagattgatttagaattaaaaagaaaaatatttacgtaagaagggaaaatagtaaatgttgcaagttcactaaactcctaaattatgctgccctttatattccctgttacagcagccgagccaaaggtatataggctcctttgcattagcatgcgtaacaaaccacctgtcagtttcaaccgaggtggtatccgagagaattgtgtgattgctttaattaatttcggagaatctcacatgccactgaagattaaaaactggatgccagaaaaggggtgtccaggtgtaacatcaatagaggaagctgaaaagtcttagaacgggtaatcttccaccaacctgatgggttcctagatataatctcgaagggaataagtagggtgataccgcagaagtgtctgaatgtattaaggtcctcacagtttaaatcccgctcacactaacgtaggattattataactcaaaaaaatggcattattctaagtaagttaaatatccgtaatctttaaacactatgtagttaggtctccctcacaatcagtccatttgggtagcacggtcctcaggacgtatctattgatggattcgtccagttccatcaccattacgctcccgttaggaacattggtaaacgattcaaactcttcgtatgtccatctaaaccatttcatcaggaatactctggaataaataccatgtgtaactaggacaacaacatctctgggtcttctctcttgcctatcatggaagtgcctgaataaagtctcttggaaactggcgactctgtcatatacatctgccgcactttctccatgagggaatctgaagaagaaatgaccatacgtagatctcttcttcataacgtcctgcatgctattgattttttggaaattaccaaaatcttgttcccttattcttggctcatccttaacccgatattgcagataacattttccaggcttcccttcacaaatattatcttcattattttcgtaaacaccaccagtattattaagtcctctcggccaaaatgcatgtttctgtttaccatgtggatcatatctcatatcttcacatatacgaacaccactgtttaattcattatattcatcgatgacgtccaaaatacctttcaatgtttcccttgctcttctatagggtgatgtataaaaaactatgtttgtgtctttttctctactcagcctggtatagtccttcagcggtaaagttctcctgctactttcatctttaatatacttcttagccaaatcctccaccaagttgtgatcgtctacgtttaaaacacgtaataagtcaataccagcttgtctagcttggatttgacctgttttcgttaaagaaatcagatggttaggaatataaccattgacctccttgtttttatttgattcgctttccccatgccttattagtacaattaacctaggtctggcattcgtaaaagaaccgtgactgccagcaacatcttcactaacatgaacattctcttcacacatttcttttactaatactctgagttattcaaatggaatgctgtagcgtaagttcttttatgttgaaccatgaatacgagctgcaattaatgcagttgagaactagctttttttttttcatgcctctcggtctctgcaggatatcgggtaaaaatgaaaactgggacattaaccgcggtgggtactcgatcattatttgttcagaatgagttatgatatgaacggtaattaatctagatgataatatatatatgtatatgtatatatatgcaattgataatatatggacgagtaaataagagttaagtcaatagcaagaaagtaacaagggtgaatgagaaagtgattcaataacattgccgttgatagcttttttgttccgagcagcaatggaaacggaacaatactattttgattttatcactaaaagctactgcactttacgtcgtgtccctatatttgaaatctgagattttcaattaacgagtcaatagcctcaaaatttaaatcgttttcagcgaaagacaaatgcttctcagaaactatgtgttgttctaaagattcgtattttacacgacaattttcacagtatccggaattttttaccgtttctttcttcaccggctgtgctgtctgtgctgtctgtgcgttaaaatgtaaggtgacgtttgtggaagttgatttcttcgatgctgttggagattctgtggttgttatcttgatgtcattatgaactttggagtctgcggagactgatttggtagctaccttagggaaattctggggctttctattagtttctaagtgtacagcactatctttgcccgtctctttcgaaggggcttcgtcttttttcaaagcattaaaatctaatctgtgtctattttcctttgatgtttcagcagtagttgctatagtggctgtataatttttgttatttccatttgtctgctttactcccagctttctatcaaccattagtctacttaatgacttcatgttcttactcatgacgcttgctcttgttgggcccaaaccattgccaaaagaggttgccacatcattagattgatgtgcaccacttgctttgatttcaaatgcctgacgtgactttgttttcaaagtgcacaaatcatccggcacttcttcagtttcttgccttgcaaaagtagctaatactggatggtttagttttggtgtggcagccagctcttttcgctgtgggtacttattcgattcttctgctatagattgtttattttctttttcttctttcaacggaggctctttggtttcagtttcatttaataatatactatttttttcatcggtttggtcagcatgttcattacgaacatcttgaactgcgctatcatccgtcttctttaactcggtcttctcaaaattttttgccttttcttgcatccattttttgaagctcttggtagaatcgttgcatgtgtgaggtatgaatattaggtttttcgtttgatcattaactgatgacgtattcagtaaggtgtcggcatgatattgaaatagagcacgaagttgcagtgcatattttttgtttgctttgtctctcgagtatctctttactacgcgcttataagaactttcgtcataattcctatcccctataaaagggcatcttccgaatgaacctattttcaatattgggtaaggtagttcgtctaagtttgttagttcttgaggtttccattccaaagttattatgggggcccaagtttgccataggtcataaaggtatacatgaggatatttaaagtagtgaatatcgtctcttttagttctggggtctctatccgttggtccatataatttttcattgtgtagaagattggacaatgtgggcgcagctaaagaagcagatttagtcttgctcaaatgatccaaatcaacatcaagatttttcagaaatctggcagccttttcgtaactccaaactttcatgtagttttttttagctctcgataaaatgtcggtatcttttagtaaatatatgttctcaacagaccttcttgtgataactattgtgacagtagtgtcaaaaaattgagttatttgcgcacccaatgtaagaaaccctcttttcaataaatctctgcgtttgtccatcttggacttattatatgtattcatctctacatcatcagtaatgtcaaagtaaatgcgagaatctcttttcattatctttttccaatttgtttgccattccagcaattccttaggcgtaacccttggctcgacatttttcagacccgtacctttgctgacttggacagcgccttcaatagacctggccctttctattctggcccttttcttttcatgcaaatgctgctgctgttggagctcgaggcgctcaagagatcttttcttcggaaaggattcagtggtattgttattgttgcaattattgtcgttagaaaacacattcaagtggcccgctgctgttgttgatgcggcaattccattattatgtttcaagttggtatctgtttcctttaacggagaccttattatcattttcgttggagaaaccattttcttctttcttttctaaatatgaaccaaaagcagaattccaaatgcctttcagattcaaaccttgaattctgaagataactagccctgcaagcgaattcagatctaaaggaatctacacctggctgagtatagactatgcaacttgatttttgtttttcttggcctgagccattaccgttattattatcgttatttctttatttttttctttttcgcaaagatcgacctaagacgcgtttgcaaaaaaaaaaccatttacttactgcgggtaaaatattaaaagaaacttaggcgttagccaagaaccgataagaaaataaaaataaaaaaggtaatgaggaattagatgcaaagagatatagatataaacacacacacacaaatatatatttatatacatatgtatggtgatatatattcaaaaaaaaaaagtacagtaacttagaaactattagtgggacggatttggttttcttatttctttctttttaaaaaactttcttaatatacacgtttgtggttataaggtggtgtaaagtaatgtaatgatatacactttttttctcaattctttaccttcttctttcgtacggtgtactgcgagaagtaaaatgggatgatgaattaatttttctaaatttttcttcgacacttagttattttcttcttcccctgtcaatctcagattatcatagggaaaaatgtaaagtgctttatcgacaacgtatcgcgtatgtataaattgattcatgttttgcgtttgagctgaatatgttttgttaaattttgtcttctttcttactgttcttttttatattttctttgaaactctttctacatcctccacatcttcactttcatcttcagccttgtggggttgtttcctatccatgacgctgtcgttatctatactatcgtcgtcatcatcgtcatcatcttcgaattcgattctttcgtcatcgtcgtcgttgtcgttatagttgtaaacgtcatcatcttcaaaggggatatggttgtttccatcgtcgtagtcgtcgtcttgtaaaatgacggacccgttctcatcgtcgtccaaatcactatcataccaaaaattatccgccatatccttattcgattctggttcatctagtttactttgagatatgtacgccgattcagaagtgggcattatgaaacctttagggatatcttgtttcgatctttccacttccattttgactctttgcttgtattgttcagggttctttctgtaatcaacagcggcatcgacatttgctggcgagttgatattggggtcctctaatagagatactatagagatcaacacactttccacggtctgcacgggggaccacgtttcagcatcaggttcgtcggtcataggatccccactttgatgtaaaatagaaatacaaagcctgccatccctgtaaacgtttggatggtagatagccggcgtaaatcgaaactgtggtggagaaaagggaaagtcttccggaaatctcatttgagctttgaaaaaccctccatgataaatggaatcctcatttagcaccataacacctatgttccaagtgaaaatatttgaatcatcctctagttctatatgaaatgagggaatagctttcttaggatcagtaagttctctatattgccgtaacagtaagctagaagcggtgcttttgcgactactcatatttacgttgtattgttcttttttccttgtttggtgtactaaaaaataacagtcgctataagtcctaaacagtaaaggacaaagatgtcagcggcagagagtataaaggagtactattcgactgaaataacaaacgcaaagctcctattattttgtaatagtatgctctttattgtccttcttaactttaagtttctgctcttgttctttacagattcaagaggaaaccaaaaaaaaatcaaagaaaaagaatcgaatttttcccaaaatgaaagtgtaaggaaaaaaaaagaggagatagaaaatccgaagaaccccaagggacggacaaacacaagacgatgctgcacgtggttagttttgtaagcgcaggttacgataaagagcataaacaaatcattactaagagcggtatacaagaataaagtgacaaacagttctccctatttaacgcacttaacgtaggttccatcattatgatgctattgccacatcaaatctcctttggactgaacccgcattagtaattgcccgcttttcttttcttccgcgggtgggccccataaatagaaaaaaaaagaaagaaagcgtttaaataaatagagtgagcggatttctattatctgaaaaccgggttataatgcacgtgatatgcacgtgggagctgggcggctatttttttctttttcaaatgtatttgagtcgtttaaaatagcactccccgttgacccgccaactcatttttgttttctctttacggaaaaggctttaaattaaggcccgcattttcggtatccttgagggaaaaaaaccaaagaaacccaaaaaagaccacaaagctgggatatcttaattagtagagagggcttttagttttaatagtgttacgagtctctaaaaatagcgtaggcacactgccctgattcggactttgatcagagtttattactacaaagagtaatgttgaatgattgggctgggttttcatagcattaactctaagtaatatcattcaaccgctcaaggttccttacgagcaaacccatatatgctctacagataaacatataaatagcgtgcatattcttctctattcaactcttgctctgtatagttcaatagaatcttacagtacatcacgctgcaatagatctaatccaagagagaagcaaaaaaaaaaagctcgctataaaaatatcatgcaattacattcacttatcgcttcaactgcgctcttaataacgtcagctttggctgctacttcctcttcttccagcataccctcttcctgtaccataagctcacatgccacggccacagctcagagtgacttagataaatatagccgctgtgatacgttagtcgggaacttaactattggtggtggtttgaagactggtgctttggctaatgttaaagaaatcaacgggtctctaactatatttaacgctacaaatctaacctcattcgctgctgattccttggagtccatcacagattctttgaacctacagagtttgacaatcttgacttctgcttcatttgggtctttacagagcgttgatagtataaaactgattactctacccgccatctccagttttacttcaaatatcaaatctgctaacaacatttatatttccgacacttcgttacaatctgtcgatggattctcagccttgaaaaaagttaacgtgttcaacgtcaataacaataagaaattaacctcgatcaaatctccagttgaaacagtcagcgattctttacaattttcgttcaacggtaaccagactaaaatcaccttcgatgacttggtttgggcaaacaatatcagtttgaccgatgtccactctgtttccttcgctaacttgcaaaagattaactcttcattgggtttcatcaacaactccatctcaagtttgaatttcactaagctaaacaccattggccaaaccttcagtatcgtttccaatgactacttgaagaacttgtcgttctctaatttgtcaaccataggtggtgctcttgtcgttgctaacaacactggtttacaaaaaattggtggtctcgacaacctaacaaccattggcggtactttggaagttgttggtaacttcacctccttgaacctagactctttgaagtctgtcaagggtggcgcagatgtcgaatcaaagtcaagcaatttctcctgtaatgctttgaaagctttgcaaaagaaagggggtatcaagggtgaatcttttgtctgcaaaaatggtgcatcatccacatctgttaaactatcgtccacttccaaatctcaatcaagccaaactactgccaaggtttccaagtcatcttctaaggccgaggaaaagaagttcacttctggcgatatcaaggctgctgcttctgcctctagtgtttctagttctggcgcttccagctctagctctaagagttccaaaggcaatgccgctatcatggcaccaattggccaaacaacccctttggtcggtcttttgacggcaatcatcatgtctataatgtaatggaatgaagaaatattcttcatttttgataactagtacctgtcattcacgacatgtgaacaaataaaaacatttatttaaaaattttatgtattcaaatattttcgggaaagagataaaagtaacgacacttaaaaatttaaaaaatcacaatactttatttactcagtcttttgatcagctccggcacctccttgttgttgcttctttgctgagcccgcaacaaaattgtaaatcaataggcctaaaagtaacattttccagttcttttgaaaccaagacacctccttaacctcttcatcttcttcgaattgtgcagtgcttccatccttattcttactagcttttttatcagcataagttttggttttcttctttaatttggtgactggtgcagtaggtcccgcttctggatatctgactgtagcagtaatagcatcgttagtctcgtcatatgataacgacacttgtttgacctcattatcttcatctacatccacaattaaatcgtattttagtggtgtcctcagcttcatgtagctaaaacatggcatatccagcttaccttcaatctgggcattcaaacagtattctccagaaacttcaacatcctgtatattaacggttgttactgtaacattcccatcggatgtactatcaatctcaaatgttcctaggggtatagcgtctttcgcatcatctgaatagcttaattgtaaaatatcagcacagaaaaccatgctggccaataaaatcacacgcaacagccgcacaagcatctttccttcaatgagtattgtacagttcttgttagatagtgttgaatagtaccaccttgtttttttactcaaagtgtcttttatatacttctaattattcctatatttggttgggtttttaagttaccaatgcaaatacagtggttagagacccagcgcacgtatgcaaaaaaatacagcggaaatttcaagtaaaaatgtagcttcataaaaaagaagcagattccctaaaataagcaatagatcttcacatatatcgttatcatcccctttcttccctgtttcaatgcaagctaaaattatatatgctctgagcgcaatttctgcgttgattccgttaggatcatcactattagcacctatagaagaccccatagtatcgaataagtacctcatatcttacatcgatgaggacgactggagtgataggatattacaaaatcagtctgtcatgaactcgggatatatagtgaatatgggcgacgaccttgaatgctttattcaaaatgcaagcactcaattgaatgatgtattggaagactcaaatgagcatagcaatagtgaaaagacagcattattaactaaaaccctgaatcaaggtgttaagacaattttcgataaattaaatgaacggtgcatcttctaccaagccggattttggatttacgagtactgtcctggcatagaatttgttcagttccatggtagagtaaatacaaaaactggtgaaatagtaaatcgagatgaatctttggtctaccgcctgggaaaaccaaaagcaaatgtagaagagagagaatttgaactactttatgacgatgtaggatattacatcagcgaaattatagggtcaggtgatatttgcgatgtgacgggggctgaaagaatggttgaaatacaatatgtctgtggcggctcaaactctggaccatcgactattcaatgggtgagagaaacaaaaatttgtgtttatgaagcccaagttaccatacctgaattgtgcaatttagaattactagccaaaaatgaagaccaaaagaacgcctcacctatactttgcaggatgcccgcaaaatcaaaaattggtagtaactctattgatttaatcaccaaatatgaaccgatttttttaggttctggaatatactttctaaggccctttaacaccgacgaaagagacaaattaatggttactgacaatgccatgtcaaattgggatgagattacggaaacatattaccagaaatttggaaatgccataaacaaaatgcttagtttgagattagtatcgttacctaatggacatattctccagcctggtgactcatgtgtttggttggcggaagtggttgatatgaaagatcggtttcaaaccactttatcgttgaacatacttaattcacagagagcagagatatttttcaacaagacgtttacatttaatgaagataatggaaacttcctatcatacaaaattggggatcatggcgagtcaactgaacttggtcaaataacccactcaaacaaagcagatataaataccgcagaaattcggtcagatgaatacttaattaacactgataatgagctattcttgaggatttctaaggagatagcagaagtgaaagaattattaaacgaaatcgtaagtccacatgaaatggaagtaatatttgaaaacatgagaaatcaaccgaataatgattttgaactggcgttgatgaacaagttgaaatcctcattaaatgatgataacaaagttgagcagataaacaacgcaaggatggatgatgatgaaagcactagtcatacaaccagagacatcggggaagctggatcacaaacgacagggaatactgaatcggaggtaacaaacgtagcagctggtgttttcatcgaacatgatgagctttaaacaaggaggagtataaacttttaatttttttttttcacgttttgccttttatataccgattaaatatttatatttctgactttttctttaccgacaccaacaggtgtaggctcaaaacataaaaaaaaagagtattctataaacagttcttacgaatagaacaactcttaaaatccttttcttgccaagtcatcggttatcttcaagtaaaaattcaggatgtcaaccttctctccgacagtagtggtacgaaaaaatttactccaatcatcctgtaacttatttttccaattgatgacgtccagatgatccatgtccttcaaagtccccctgtattcaccccatttactactatttatggttacaaggccatcgttggggcaacctttagacctttcataaacaattttccagggagtacaaaagacattgtaccacttaggcacaaaggagcatccatacgaaaaataagagacttttggactatttggcgtaaccaaattgaaatatttcatatacgcagtcgtgagttggtagaaacatattggcaatatcttttggctaactctcaaggcatttagattttcaaaaaggtcgactacgtaatcggccatttctgaccctctatgtggagttgaaatagtggttaggctcaatatatcgtaattcctattttttatattgcaaattagatatcggcagtctagtccccccattgagtgtgcgattagatttaacgaatgtcgcttatccttcgactcgattttctttacttctttctgtaactgagcatccaaagccattgctctttcctcgatgctaccaaaacctggtaccttagtggtgataacagtacatcccttagattgaagaaattttttaacgccaatccaatattcaatctccaacaaatttgtgtacttgttatcactcttatcttcgtcatcctgcatgaaattttctgccatattatgtactattgaattggaaattaggtttgtcagatggaatacagaagggattagaattaatttgtcaaatcctgataaaccatggcaaaatacaataggattttttgggggcttgtacgaatcaggaactttgacggagtctattattatatcattagctttattatcatttttcattttttttatgcttttcctcctttaaaacaagacgctttattctctatattcttccttgtacatattttcaatagcggttcatattaggctcattatgagaaaaggttggtgagaaatttagcatattttaaacaatcatttagctagatgaatcagaatgtttttccgacaaatagtagctcgcgtggcgtaatggcaacgcgtctgacttctaatcagaagattatgggttcgacccccatcgtgagtgctttgtttcttccgtgatagtttaatggtcagaatgggcgcttgtcgcgtgccagatcggggttcaattccccgtcgcggagaattttttttaattgatagtagcaggtacaggagaaagagtaaataatagaaagcaaggtacgtgatgggaattgatcaaactaatatcgctatacctataagaatttgcgtgtttgtatacgtaaagaatatataatatattgatgtgtgcgctgaggaaggtaagtctacacaatttatccgttagcccaaattaatcaaacagcatattttttagtccactccttagcggtggcttcatacttagccttatctgtcttgtagatttgagcaatttcagggaccaaaggatcgtcgggattagcatctgttaaaagagagcaaatagacaacaaaacttttgaaagggttagcgccggtgaccactggtcctttaaaatatcaaggcagatattaccactcgaattaatattcggatgataaattttggtcgtaaagtttaccttcggtggcttgaatggataatcagttggaaagtgaatagacaaaaagaaaacgccaccagcgtagggtgagtctgaaggacccataatagaggcttgccaatgatacaggtcatcccctacaggtcctgctgaacatgaagcaggaggatctcttcggaaaaaagttcaaaaaagaaactcatgttagtaatcctttttctttacagatcaagaaaaatcattcattttatttttaacatacctccctaaatcacttaattccttggcaatacgcttggaggaagacatttttagtttagttgagggtggtgagcagaaaatgacttttcaagatggtagtcaataagcagtcctgaccttggaaaataaaactccaaccatctattaaaatccgggatacaattattttttataattttgggtcggctatctttggtacaaatgagtaaggcggcagccgctttattacccgctcgcagtggcaactacctccaccacagccatgcttcaaaacgcttgctacgagagtttacaccgtactagcactagcaatacatctagatatctaattgaattacgcacaatataagaaaaatcggtttatgagcctaatgaatgagtaccaaaataagtaggcaaaaagtacagcctctcatggaacaatgaacacaaccctagtataattcatctgtactttgggactttctgtgtaagtaaaccaagacataatttaatatatttgagaaatctatccttatccaattggttgttgcagatgatttcatataagcaaaaatgttggtataactttcaccacatgcaatagcagatcttttgtataacgcgtattgcccaacataatctaagatcagatcattaataagaaaatctcatttccaaaaccgattggacatatactgtttagtaataaccgccgatatgatgttcttccgttctcttgcctctgtattccgttacccgttgcagaatgaaaaattttttcttttggcgatgaggtaaaaaattatcagagatgccaaagtaatggagttgcgaataagaaagcattatgtcgtacacatcggaagcgaaattctatagtttgataaatttctatagatattaaacctctccagtgtctttgttggtacagtaatcaaaaataatgagtgagaacaacggcaatccgctggatttgtcttcactaagaaataagatttcgtcaaaattgcgagacaataacagcaaaaaggcgaagaaaacccacaaaggcaaggacgtgaaggccagtagtaattcaaagaaggtaaatgaggacatacgtcgtgaagcactagcattgggtgccagcgaagaagatctaaaattgattcaaggattaagcgatgatgatgacgctaagagcgaacaggaatttgatgccgtcgctgacgaggatgctgacgacaagggattcaagaacgatcttcaaaatttcatgaagaatgtaggatttgaccaacacaaactcgaagatgtagacgatgacgatatagaagaagaatccactagctccaaagaatctaaaatacccgctcaagagaaggaacatgcacaatcaaacattgcatcatcgacaatagagaaaacctcccaagagtcaatcgataatggcagtgaacaagaagaaaacacagtagaagaggctaatcttagttcagaccaagagccagaatcagaatctgcagagaaagaaaagaaagaggagaaagatggaggtttaattactcaaactactattatctcatctgacaaacttattattccttacgataaaccatggtatgaaattccattggatcctcaagttggacaaaatgatgatgttgaagaattatccaaggaacagattgagaaactttttgaaagaggtaagcaaacgctagaagctgacaaccaaacttactatgaggagtttacaaaggactcatcgcaggccaagttcatgtcccaaatcctatcggacggtaccctcaacgataaaatatctgccgtaactttactcattcaagattcgccattgcataacactaagtctttagaaactctggtttcatattgtggcaaaaaatcgagaaactctgctttacagagtttaaacgctttgaaggatttattcttaaatggtcttttgcccaacagaaagctgaggtatttcaaaaatcaacctggcttatctatgatgctaaacaagaaaactcttgcaattttctatttcgaagattatttaaagaaactgttctttcgtgttttagaagtcttggaagtgctttcccacgatccaattattcacgttagattacaaatattaaatcatgtatttgatttattgaccaaccaaccagagcaggaatttaatttattgagattaggtgtaaataaaattggtgatattgattccaaagtttcttcgaaggcgtcatatttactactgaagttggaacaagctcatccgaatatgaaatctattgtcattgatgctatcgttgatatcgcattgagaccgaatgcggattatcataccacttactattctgttattactttaaaccaaaccatcttaaaaagatcagaagactctgttgctaataaattagtaaaaacatacttcactttgtttgaaaaattcttgattaatactgataaagacaataccaatggcgttgttaagagtaactcaaagtcgtatgaggagaaaagaaagaagaactttaaaaagggtaaacacggtggtaaatctgtaaaaatcgaaaaaacggaaaatgaagttttagatgaaaagaactcaaaattattcagtgctttgttaacaggtatcaatcgtgcattcccattcgctcagattccagcgtctgtctatgaagtacatatggaaactcttttcaaaatcacacactcctctaactttaacacctcaatccaagcattagttttgattaatcaagtcaccgtcaaagcaaagttgaacagtgatcgatattatagaacattatacgaaagtttatttgaccccagactggtgaactcttctaagcagggtatttacttgaatttactatacaaatcattaaaacaagatgcactcaacgttgaacgagtagaagcctttgtcaagagaattcttcaagtttgttctcattggttgaacgtcggcaccattactggttttttcttcttattaatccagttggctaaaacagttccacaaataaaaaatcttctaaccaacacgccagttgattacgagtatgaatctgatgcagaagaggagcaaggggacaaggacataaaaaggaaggaatacgacggccgcaagcgtgatccaaagttcgccaatgctgaaaaatcttctttatgggaaatcaacaacttcatcaatcattttcatcctactgtgaaaacatatgcaaacgcctatgtgacaggagaaacagagcaaatagctaaaccagacctgggtctatttactctatcacacttccttgacagatttgtctacagaagtgccaagcagaccaatacagcaagaggtacatctattatgcaacctctgtttagtggctcacgagttaatgactctgtcttagttaaggcatctgatattatgcatgaccagggtcccgtgaacactgaagactggctaactaaaaaagttgaagatatcaaacctgaagataaattcttttatcaatatttcactaccaagaaaaccgctgatggaaaaggaaagaaatctaacaaagcatctaatttcgatagtgatgacgaaatggatgaaaatgaaatttggagtgctttggttaaatcgagaccagatgttgaagatgatagcgacgacagtgaacttgacttcgctgaagatgatttcagcgattcaactagtgacgatgaacctaagctggacgcaattgatgatgaagatgctaaaagtgaaggcagccaagaaagcgatcaagaagaaggcctcgatgaggatattttttacagtttcgatggagaacaagacaatagtgataaaaaacgttccttcgctgaaagtagtgaagaggacgagagcagcgaagaagaaaaagaagaagaagaaaataaagaggtatccgcaaaaagagcaaagaagaagcagagaaagaatatgctcaaaagtctaccggtatttgcatctgccgacgattatgctcaatatttagatcaagattcagactagaaaataataatacattaactaaacacttcggtgttgtaaattaaataaggaaaacagaattttgtacaataaaaaacggtccaatacgaaaccttgaagcgaaagacgcatatcagagttttgctgataactctacttatgtccgcttttcaacattattagagcgggagtaaacggaaaaagagtaatgcggaaatagaaacggattttagctacaactatgtcagttgaaatcgccgagattgctgacatcgtgagacgaaactaaaaacgatggaaccacgtgactcctattagaaataaataatccagaactcatttttaaccattttgtttatataggcacatttgtagcgacaattttctgttagctaattgcagtaagcaaaacaaatttgtgaatacttgattaatattctgtgaaagattttttaattatgagtaccaataagttcgttgtacgaataacgaatgcgctcttcaagtcatcactggctagcaacagtccacctgtttaccctaagaggattaggcatttcgagattttacccaacgaaaaatgggttatatggggacctggaaagggcaagttcttggatgtactgaataacaagtatatttgtgagcccccattatctttgaggtttggatttttgaaggaaagttcgaacatcctgccgaggatagagcaagtggccttcaaaggggttatgccaacggctcatttaagtgctagatatgaatacttcaaagatgactacgatcaaacctgcaaacagtttatatttgataaggcaagcggatcaaatgctgtttcatataaagttgagacgaacaatcggcaaataaacatggagctgtacaatgcattagttgaaaatttaaacctctccagtttacaggataggtgggtaatgggattgagtaatggacaaatgaggagagcaaggttagctcgtagtatactcaaggaaccggatctactacttattgacgacccatttttagggttggatccagccgcaatagcaaccatttcacaatttttagccaaatatgatagtatagaagtcagtggcggatgtccaatcgtcattggtttgaggtatcaagataccattccagcatggtgtactcatatatgttgcgttgatgagaaaaacggtatattgtttgaaggcccaatcgaaaaacttcaaagtaaaatggatgaaaccagatcaagggcactaaaagaactagagcagctcaaaaaagcgtctaattccaaagaggacatttccattaacgatttgatttgtatacatcctatgtatggcaagaaagagcacgaaattatcaaaatgcctcatcttatagaattagacgggttgagcgtttcatacaaaggcgaagctgttttggaaaatctgcactggaaagttcagccgggttcgaaatggcatataagaggtgacaatgggtcaggtaagtcgaccttattatctttgcttacggcggaacatccccaatcgtggaattcgagggtgatagataatggcgtcccacgaagaacaggtaaaacaaactactttgacctaaacagcaaaataggtatgtcatcacccgaattacacgcaatttttttgaagaatgctggaggaaggctaaacattcgggaaagtgttgcaactggctatcatgaggcgtcctccaacaattacctacccatatggaagcgcttggacaaaaatagccaagaaatagtgaatatgtatctgaaatattttggcctggacaaagacgccgatagtgttttatttgaacagttgtccgtaagtgaccagaaactagtcctttttgtcaggtctttaattaagatgccgcaaatattgattctcgatgaggcattttctggaatggaggtagaacctatgatgcgttgtcatgaatttttagaggagtggcctggaacagtccttgtagtggcacacgttgccgaagagacaccaaaatgtgcccattacttaaggctcatatctcctggagagtatgaaataggcgatatggaaaattaaagttttctgttgtgtggcagcaagagacagaacctcgataatttgacatacgtatataatagtacatgtacataaaaagctacgcaaatatcgtatatctgttatactacaaaacaattacttctatatcatagccagttagcgggaacgacttcagctaaatggactatccatgctttaggcagaggcgaagcgcggtgattgggtgtaacatcatctccttttctctacgacaaattcccaaaaaaaaaatttatgctatgttaatacctgcacaattcaaccgtgctgaaacgtaaaattaaggtgattatacggatagtatacgatattatcaatctcataagaaaaatctcttttgaatttaacggagggattattcattagaaagcgttcttaccattcactaggagcgaatccgtggaaggtgttttaacgttgccacgaaaaacagctctacatcgaaataaaagacaacaatcagtgcccgtaagtttcattactattttctattattatctgcaactttttattagttaggttttttttgtttgtttgtttgttttcaattgattaatttacaagacaaagaaccttatatttcgtgtttttcattctaaaggaaaaaaagcataaagaagattccacacactttattgtgatagttttcaaagtaaaaagtaatagattatgagtactcctgcaaactatacccgtgtgcccctgtgcgaaccagaggagctgccagacgacatacaaaaagaaaatgaatatggtacactagattctccggggcatttgtatcaagtcaagtcacgtcatgggaagccactacctgagcccgttgtcgacacccctccttattacatttctttgttaacatatctaaattatttgattctgattatattaggtcatgttcacgacttcttaggtatgaccttccaaaaaaacaaacatctggatcttttagagcatgatgggttagcaccttggttttcaaatttcgagagtttttatgtcaggagaattaaaatgagaattgatgattgcttttctagaccaactactggtgttcctggtagatttattcgttgtattgatagaatttctcataatataaatgagtattttacctactcaggcgcagtgtatccatgcatgaacttatcatcatataactatttaggcttcgcacaaagtaagggtcaatgtaccgatgccgccttggaatctgtcgataaatattctattcaatctggtggtccaagagctcaaatcggtaccacagatttgcacattaaagcagagaaattagttgctagatttatcggtaaggaggatgccctcgttttttcgatgggttatggtacaaatgcaaacttgttcaacgctttcctcgataaaaagtgtttagttatctctgacgaattgaaccacacctctattagaacaggtgttaggctttctggtgctgctgtgcgaactttcaagcatggtgatatggtgggtttagaaaagcttatcagagaacagatagtacttggtcaaccaaaaacaaatcgtccatggaagaaaattttaatttgcgcagaagggttgttttccatggaaggtactttgtgtaacttgccaaaattggttgaattgaagaagaaatataaatgttacttgtttatcgatgaagcccattctataggcgctatgggcccaactggtcgcggtgtttgtgaaatatttggcgttgatcccaaggacgtcgacattctaatgggtactttcactaagtcgtttggtgctgctggtggttacattgctgctgatcaatggattatcgatagactgaggttggatttaaccactgtgagttatagtgagtcaatgccggctcctgttttagctcaaactatttcctcattacaaaccattagtggtgaaatatgtcccggacaaggtactgaaagattgcaacgtatagcctttaattcccgttatctacgtttagctttgcaaaggttaggatttattgtctacggtgtggctgactcaccagttattcccttactactgtattgtccctcaaagatgcccgcattttcgagaatgatgttacaaagacggattgctgttgttgttgttgcttatcctgctactccgctgatcgaatcaagagtaagattctgtatgtctgcatctttaacaaaggaagatatcgattatttactgcgtcatgttagtgaagttggtgacaaattgaatttgaaatcaaattccggcaaatccagttacgacggtaaacgtcaaagatgggacatcgaggaagttatcaggagaacacctgaagattgtaaggacgacaagtattttgttaattgaattttacctaattgctagttaggtgaaaaattacaaaatttctggaagacgttggaaacacgcaacgtcttttttgacataaacttaaaactgccaaaagtcaaacaaaaattgcaaaaaaagtaaaaaaagttacgaaaaaaaaaacatttaaaagaaagaagaagttaaaagtgcacgcaatatgttccaggatatgaaatgaaataccttttgtttcaccttttaaataatttaatgttatatatacaactttatcgtatcatattcgcaattacattatacaagaatgagtttttttttttcgcggacaaaagaagaacatgtcaacgccaaccccctaggtgattttgttagacaaaagcgaattaggatcagggtctgttaaactttaaatggattatcaattcttttgttcactgattttgaatttatcagctaccattgatttaaacccattatttagttttgcaattgcgtcctcaaagcatcgagcaaacaatcatgtcgaacctctacaaaattggaactgaaactagaaataaaatcaagaagtttcgtacatctacagcaagaaccgactccataaaagctttatcaataaagatcgaaccaaaaccgtcctatgagataattgtcgatgaagacgaacaagaagagctagacgaaattgaagatttgagcgaattagccgagatcctacctgataactcacctagatttgtactaactgcatatccaacaacaacaaaagatgggttcaaacagactcccttagttctagtatattggaagccaatgacggtcgtttcacaggaatggaagatgctttatgccggcgcattagaaatgatcagagaggagtgcggtacttttaaattgatagaggtttcttcaggtttggaggatgactcagacgttgaagaattgagggagcaattagaaaattgttagtatagtctatcttaaacactaaactacctcctataatcatgtagtgtactttaaacatttttttatcttcatagcaataatataagccttttaccacccataaaccataaagtagacccaaacatttttaaaaaaattttacgttataattttttctttgtcgttttttctgagcgcgcaaagtagcggtgaaattttgatacgaatgagatttccacttctgtacagatggaaatttatgttggccgacatatatcacagtcgtgattgaattaacaatttctttctcattaatatttattctaaacggttaaccactaaatcaatcaacaacaatcagtcaaaatgggtcgtatgcacagtgccgtatgtttattaacaccatagcgagatattaatgcaaaagttgcattgaatagttcgctaaatcagatgacactctaatgtggaattcaaaagtggatttctaatataatttgtctctgtcggatcacaattctattacaagttccggtgtgtacacaggtatagtttatactggagagtagtttctactcgctgtacattagctgggtgattccaatttcttttacaaatatgttgcattagtttaacaggttatactatctgccgtttctcagtataatttacgccggaaaattactgatggctagccgcctttatgaattagttttcacaaagctcataacataacacgttaacctatcggaggagaaccaagattgaagaatcacccggaatagttatactttaatggaattgtatggtctgaacgaggaaatatgtcatgatacacttttcttcaagccatatgaatcttcatgttactaacattcgataaattttttggaatatccaattccactaaatattactttaaacagggtaaaggtatttcttcttctgctattccatactctagaaatgctccagcttggttcaagttgtcctctgaatctgtcattgaacaaattgtcaagtacgcgagaaagggtttgactccatctcaaattggtgtcttgttgagagatgctcacggtgttacccaagctcgtgttatcactggtaacaagatcatgagaatcttgaagtccaatggtttggctccagaaatcccagaagatttgtactacttgattaagaaggctgtctctgttagaaagcacttggaaagaaacagaaaggacaaagacgctaagttcagattgattttgatcgaatctagaattcacagattggccagatactacagaactgttgctgtcttaccaccaaactggaagtacgaatccgccactgcctccgctttggtcaactagagtgtttaaatcatttatttcattattttatatgtatattttgtataactaaaattgattttttaaacatctctttataaacgataagttgcattttattttatttcactattgctaatttttgtgtccgtttctaacttcaaagctgctcccagcctttcctaaggttttcagttaccaagtctgcctgagaaagcaacagattaacacttttgtaatgaacaagtagaaaatatggctcaaaattttggaaagattccttctcacaagtcttacgtattgagcttatatcggaccgttctcagaaacattccaaagtgttgccactcatatgcgtttcaatatgaaataaaaaaaacactttcaatacaattgttcaaacacaagcatgacaagtcaagttggagtgtttatactttactcaatgaattcagtttgttgaacaattgccttttggaaggtaaattacaagaaatcaaaaacttaatgaagccattaaaaaagatgaaaaaacaactgaaaacaacgaaaatcctcaactctttgacttcattaggggatgtaaagaccaacgacccagaagaagtaagaagatttcatgttctaagtgcttacattaagcgaaaacaagatttgggccttttacctgcatacataccaaaaacgtatcagcacaaactcctattaccattagcattgaacgaacatgcgtgcctgaaactatttcatattcagcaaaaattgaaaaatggcccaccttctgctgggctgtcatatacaaaagaaggaaggaatcaaatatggtttgttcggtcaccaattaacaagggcagacaacaatcgaaaaagctgggaatattgatacgaaaagaaaggaaggattctcagaaaaatatcgataatctcaatttttgcgaaattaatgctgcttgggcattacatgaggccatttgggaggaatatctagagtcgaaaaagattattaaagtaaacttaccgaaatacttggaatacgctgcaaatatcccaaagtctactaaatgtaatccttcgagtcaatatcagaaagttaaagaatgggtagatcccgtgagagaaataatgttcgaattacattccaaaagttttcaaagagtggagtactttaacaaatataaggaaaagcttttaaagaacggtggccaactagcatattttgataaaaagtcaaaagaaatgtacgccaaacggttgacactattcagaaaaatgagcaaagaaacattaccatatgtgacactctttatagaagggagggacttgccaagtgttttggcgaaatacggtttttaagtgcaaaagttgcgtgaatcagaaagtttaatagaaaatttactggttacttccatttctatgtaaatagtcactcgtatgaccgcgataaggatcctgatgaagacgatttaattatacttcctattctatacaggtttcctcatcagtagtcaactgtccaaagtacacatccaatggtaaaggctcattcttgtaggtatcatcaaactcaagatccttgaaactcgttatcagcgatttgacggtatctataggtacctcacttccaactaattcttctaaaaggcttaccgagtacatatcatcaaactctagattaatgtaactagttaaatgcacgcctcgcctttcatgcagaggcgtttgtgataactgtctcattaaatacaacgaacatttactgtgataattattacaatacattgagtggataaagaagccatcagatgaattttctgccgcactcttatagcatagcgggtacccacatattttctttccccttcttgcattaataacatccatataagacatcggtgaaagtagccgtgctaagtattttaatgtctgctcattttcgcaaaatgattctgtgagcattgaaactatggcagattcaatcattcgggcttccactatagataattgctcatgtaattggtgtgatcctaaaattactttttgaatgaacgtagtggttattatctgcattatggcttgcgttgctcctgtccttctagtataaaaataaacctatcacttttcttaaatatgctgcaatttttccagaatgcctccttgctgttgataaatggcttccaatcttcgccaatactagaatgtgaccggctcgtctcttttgtaaagtcgatgtaattttcgttggacttttcaatggcatttgatattgaaaaaaatgattatcaatgctggagggcccggctaagacttaaccctgaagcttctgtctttacaaaatattatatgaatttatccctgaattttacatactatgaaattttagttttggcaaagaatttgacacgctacttactcttgcaactttttcagacgcattagcatcatcaacacgcaactcatcttttgattctgtggctgtccttgcaatatatcgcacggtaatccagggaactttatcctttatatccagatcgtcaacttcgatttcagagttaaagttttcaatgaaatttctttcatgaatattgatgctggaattatacaccaaaaactcatttagtatggataccgtactccaatatgaaaactttctcatacatgctactacgagagatattatcaattcaccattcgtacagtgcatataacaggggtaatgccctttatcaatcagaaatttaacgcatcgtactacaacatcgtattcaataggaactgttttctttttccttttaatcttgggtttggtcttgtctgcctttctttcactttgacattttatatgaattgtcttaatgttattttcttcacaaaactttaccattagaggatcagtgctcaaaggttctggtgtcaaagataatatgtatttcaatctaagggttctcaggaatgggagattgatttctcgtgggtaagatcctctatataaatttggctgtacagtcgaaaattgtaacggagtcactagtgtcattttgatacatatagcttattctagatgtgtgaactgggtattcatagcaattgtgaacccatagtttatattggtactcctttccttcttaacagagtctctttttttctttcgcattttttttggccttacatcaaatagcggtgattaatgataaaaagcacttagcagaagtcatgcaacaaaaaaagaacacaacataagggtacagctagtgagctccattgcttcgacgttttaggataaaatggaattcttttatgaagaacaagtagcttgtatcgaagatgataaaataagcaactctcataccaaggaaactggatcaacagaaaacactgaaaataacgaacttcagagccgagatgacaaaacaaatgaggccttccaaaagttagaagaggaagtcaataaacgatatgaaaagactacaagtgcattcaaaaagttagtaatcgagaaagatgacggaattgaaattaacttgccaattagcaatgaaactacagagactgcacaaaagtatttgaagaaactagacgagaatattcacagcgtggaaagtctagcccagtcatattggagcaaaatgaaaactaagaatttttggtctggcttcagtagcttcgataatgctgcagaaaatgactctaatgacaaggatgagaattcgaaagaaaatgaaattgctgtgggtggaaatagaacagaagccgaactaaggacattatctaaagataaatcggtttatttagacaataaaatggatttgcaactggacccgtttgacgtggatgaaaaaactgaggagatatgttctattttacagggcgacaaagatatctccaaattaatgaacgacatcgtaccccataaaatcagctataaagatttctggcacatctatttcttacaaagaaacaaaattctagataaagaaagtaaaaggaaagaaatattgtccaaaaaggaaaaggaaacggaggaaaaagaagttgagtgggatgacgaagaagaagaagaagatgatgacaaagtagaagcagtagctgacaacaaatctaaaggggagacgaaagttgctgtgtctcaagagggattgaaagatgttagtgaccatgttggcctcgccaacaaggatgagagcaaggacgacgacgacgatgatgactgggaatgagtgatttttttcatataaaagatatatgtaatgctataaatatttacatacttttcatgacgtattatggtagaaaggaaaatcatcaatccaagagatgcacaggaggaagacaaaatctgggcgtgatctcatctttacaccttctaaaaaaaagttcgtttgttaccgttaaaataaatcatttgtatttagggttttttactttgaccttagatggaaataatgatatgccatgttgaacgggaaaaaaagtgtatagacaacggttttcagttatttattcaaatgaatcaaacaccgtagacgcggtgataaaacaaaacgtatgcattagagttaattgcatcggctttgtttttgacaggtttatatttggtatcatcaaaatatagccatcccttctttaatccctttttcacataggctgtataatgaccaccatacaaagtaccaaagtggcatgctacaccatataattcatacttaaaaggtggtatttgtccccttattggtagttcatcgtcattaacacctggaggaaaaaccccgtcaaaatcattggcccaaaatggagtcaagtccaacaaaaaagggtatatgacgaagtcattatttttgtttaataaattatcaaatctctttaaatggactatcagattcctcggtaatctcgttattgtcaattgtttcgtggagggctgccttttttcacaatgtgggcacaaccattgctcatccacttccaagttctcacatttggtgaactctctgaaacaatcttcaatggtaatattatttcgggaattttttttaggaatagggattgacagcaccgtaaaaggttggtatgttgtcgaggtatgactacagactttacattttagtcgtgaggcgtattgtccctgaaataagtcgacaataacactgaaatcagtagtcaagaatcgttcccactcaattgacgaggcaattcgcaaagacagtttttctcttctcgcctcagcttcttgagaaagctccttcaaaggtgggtttgaaccgcattggttcaagtcttcatgaagaccatctagaaggaattggcaaaactcttggcagtcctgttgggatgcagtcttaaataatgagttaacagatccacatgccaatttaaattttatcggtgatatggaaattttctttgaaccatcaacctgttccttatacatcatatgaaccaaccttgcaaaatattttgccagaatacctttcgatcccaacttactattaatattgatgtgtttagcatatgaatcgtccaaaaagatttgggttaattcgtgtgtacctaagatacactgaatgatacagttcatgtaacacgaatttcctagattttccaaaccaaccgcgaaatcaaggtcataattatgagaagaagttggtgtaacatctgtatgatctaaagagtcattattagacaaggatagacacgaaggttgaatggtagaggtggcagaactgtgtccattggagttcatattaaggttcatactaattgtttgcgggaagcgttgtaacttcggtgtggcagttcttgatggagaagtgatggccttcgtgttgataggagctatgtgagcaaaagagttgtgattcaactgttctctttgatttgtcataaaatctgtctcactgtttttccaaagatgtggcgtttccggataattgattggcaatgaattgcccttaactgggtcaggcgaatgtagaggtaaaggcgatggtgaactagatatggacaacgaagatatagaatataagtttgaatttgaattcttcggattaggagacgtataatttgagaataattttttgaaacttgaagatctttttagcacatgatcattgtctgattgctgttgttgctgttgttgaagatgatttaatggagtaggcgcaactagcatttctttcatagagtcgtccattgaatgtcttatactgggagacatcttaggtaaatgttgtaaacttaggccagaagtgttaccattaatataaacactatcatctttaatattgttatttgatggaaaagatgatgatacttgcctcccataatttgacttaagccaacctggaaaaccagattccagaatgaaaattttggtaaagtcatcggatattggtttttcaaaggaatgattcaccagaatgtccaacaggacagactgctgtttaacattgtattcgtttgcgtctgtatagagaatgataaacttgaaaagatttctactttgaaacattttaatctcactattaggagaagtaattaatgattttttctccaaatcatgatctgaatatgacattttaaaagaaataggctccaggcatataatattttttgtatcaatatgtgacttgttgaattccaaccttgatcgtatatctatcagtagtatctccatttgggaggaagcagaatttgctgatgaacttattagggagtttaattgattggaagtgatataggaacccgttctcatcaggttacattcttcttgctcatggttcaattttgtttgttttatggaagacttaatgaaactttttatttttgcaatgttttcatcttttaataaggtttccagcaaagtgttgtaaatgttcatgagttgaaattcattattgttgttattaccgttgccctcatcactcgtgctcttatgtaatttaatcttggcgaattcacttaaatgaggaatattggttgttacaataatgtgaattaccttgtagtaaacataatttaattgaataatcattacggaatttgaactaatcattgcacccttatttttgcacgatataatatttttgatatctttcgagttcttcttgtaaatagataaaatatcgatgcatttatctagaagactgctcaaatcttgatcttttgccttaccagttatgatgaattcgttaattttagcctctgcaatagcggttagttgtgctatcgtaaggtacttcgaccggtgacgaatacactcatcccttatggtactaataatattctgctccataacttaagcatgtatcaaatagtaaaaaaaactttggaagcgtgcacactcagtcttaaatctgccctatactaccgaagataaatacatgaactacacgtatcatataacatcatatccttttttttttttttttttttttttctaggcttttactaatacaagggccttagccattcgctaaacgtaatgaacgatattgaagcaaatgaagtaaaacaatgtggaaagcaaataaataatggttatagttttgcacttatatagatatcaataaatgatatgatatgactaaatacgataggaccaggggggaaggaatatagatatgtgtatgacagaaactacatgcatatacgagtttgtaccaagtgcttcttaataaacaccgtcatctggcctgttttgttcgattctagcgtcatctcccttttttttcaaatcttccattccaggttgcttataatctggattcttgccgtgttccaaagtgtccaacctcttcttgttgctatcaaacaaaccctgttcttttttctcagcttcatcttgattgttctttaggtgaggaaaggcggccctagtgacgattgagaaagacgcccttggcgatttacgcatcaattgtcttggagtgcgcaaaaaagtggttctcaacattatcaaatatattcctgtgtattatatatgtgatactgcggtctggcttcaactgctgttggagtattgtaggaacaagtattcaaggccaaaaaaaactaagagccaactcaaaggccatatctacctaatcaaatcttgggacctttatatacttatgtgcttttacggttcccttagattctgtacaggaagaaggggttgatacaggaacaaaccctttacagtaaaggtatccttaaaaaaaaaggaaggtagtacgtatatctctccaagaactgaaaagaacccaatcaccggaattaagcagtgatatctcagtacggtcaaggatgtagggtagcaccagtagtaatgattttaattatacttggcaattttaaaatatacaaaaattatatgtagtatttataattagacatttgtaaagtgcgttaaactaatgatctagttgtcgtattcttccttaattagttctctctccatatcgatccatttctgttctgcgaagtttttgtccttagcaacattggtgttctcagcaatgatcttgaaaccaactctttcataaaatggtatcaatggctcgtgagcaataaggacaattttgttaccaatttcctgattactcaatttctgaatgtagtcagttaaaagtaaagtagccaggttttttttctggtattctggcttgattactacagagtgaataccaatatgattactcgattccacttgtaatttgcccatgctttcgatagtaatgtattcatgaggtatcttagtacccataatatgaccaattagtgtctcctttttaacttctttgccctcgatctctctgatgaaaagacctgaacatagctctggacaattgatcaaacgaaagctgataatttcttctgaagctctttcgtttggtgggaaaccttggctttccaagttcaaaatctgctttaaatcttcaatgattaagggtctaatatacatatgaagcggtagcgtgctacttgaggaggccattttaactttttatttaatcgtaatgtattggtgttattttttctccgagaaaagtattctgatgtccaattcttcttaatctagtttgttgtaaatttttcttacaaacacttgctcccgcttcttgtccagtgggatgttcgtcgttcttccattgcttttccatttttgcccgttcaaaactattctttttatgaattgacagaaaaccaaaagcaagccgatttcaggttaaccctttattaaaataaaaaaaaaaagcatgcataacactaataatatattattaaaaaaaaagccaatctatattatttaaattatccgaaattacttttattacattatgacattctatagtctatgcaagcggatcaaaaaaccattccatcttggtgccacaaaatactctcatgccaaaagtgcgagcttcgtttcttgtatccactttgtcgcctaaccttatatgaatccacttttttaaaacttttggttgtaaaacaaaccagtttatgatgatgaaacttgtcattgcatataaaacaccaacgaaaaggtcaaatctataatggtggtccagatacatggtagcccaccattgtagtattatatataggatagcccagaattttggtataaacccatcgttgactattttaaaaatccatttgtttgtgaagttcgtgtcttcatcatataaatggacaaactggagaggtttcttattgccattgctgttaataatgctgccgtcgccgccgccggtgcttctttcattactggatacggtgaatgaagatgaaggggaggaggaccgctcatttgaaatatctacaggctcaacggtacccaatggttccatctctaagtcgttagggccaatcgtgggcggtatgctattgtcaccttcatcttcgctgtcttcctcactcaacttgaaagtggaagaatcattattgtgcattgtgaaacctccagcattggaaaatctgtgttttaagctggtggaccttgaaaccaaaaacaagaaacattgaaatgcaatggcggagtgtagtgaaggaacagcaccaaacacaataggagacatgtgaaatcctttagtgttcaaatgagtacccaaatggctatctactcttatcaaaccggcagcaaacccttcctgggtgtaattaacatgttcggtgtcatcaataccgtacagatgagtaaaccatggggaggccattggaacaagcagatgggtaaggacccccgctatattttgtaatcctagggcaaaactaaagcattttaaagtccccggtggttggaagacgtataagtatacagctgttaaaattggagctgtcaagtgcaggatgacataggagaaccaagccagtaaatccttggtcttagtaaagtttgcatccgactggtaagcaaagaaatgatcaatgttgagtataacaaatgtaaacaggggcaaggcaaacggtatgaaaattgtccgaaatctcttttggatcggccgctgcttgcgcttgcaggggtaatgaaaaatatttgcgaaccactctaacagattatagttaacgtgcttaatgtaatagatgtagtaccaaatggcaaagggaatacatatcagaaatactaagagaaatgcagaagatgatatgaatgaccagaaaaatagcttcgaagtattatcgggcaattgtacagtaagttcatgccaatagtccccaaagaggaattgatcagcaaaaaaagcaaacttgctatgaatgtcaggtctgagccttatgggtatcagaccagcgcgcttgaatatagacagccaaataaacactggcgcaaaattaagcatgaagttgaacggcaggcttattagattacgttggttcaaacttgcattatacatgtttttgacgaaactcgccaaagaaaatatgacattcatgctttcttagacgttgaaagactttaggtgattcttagcagaaatgataacgtccaaccggtgaaataaaggaacagttagggtggcaatgaaaaagtagcgatgcttatgaaaacactatgccttaggtttcctttttttatttttatttgacaagtagcgattactcttctattgttcctggtttttgatgctcgaatgtattatataaaaatgttgtggccggaggtctgcatttctaggcatttttcctttttcttattttttttactttcctactaactttgcacttcgtaagagaatttacaccagaactctcgattgaggcgaagaaggcggagaaaaaagccggtaaaaaaaaaaagcggaatcaatcagcacaatcagaggcgtcaagaagcggcgcggggataatgcttttttcccgtggcgttcacatttttgttccgcggaaagcacgtgagcgtaatccactcgggaagggcgcagctgccgtggccaactgaagtaatctttagccgtttatcgccgcgcaaaacggcaattgcacttgagaccccaacggcgctgtgcagcagggtattctactacgtgttagcttgccttgcatttccccatgcgtctcgaataggaattattcaagatggattattggcatttacgagtaaccaaggataaccccgctgtgcgtgaaaccaccctcttttcacgtttcttcaaggccagtgcaaacgcgaataaacatatctacgctatatatagatatgacgtttctcaagccaacagaagtagataaagcagccaggagggtagagagtgttcaaattatagcaagccttcttctacctgtttttttttgatgattgttttgccgggtaacaatcgactttcgggcaaattttttttccttttttctcctaacagtatatacggagtggagaacagacttcccataaaagcatattacgtggggtcgtagtaagattgccgtttatgataccctctattcagggctcagagcgcatcacgatcgggagtgtaaattcaatgtgcatataagcaaaacacacagatttccttttttcccagaaaaatgagcagtgaaattgcctactcgaatacgaacaccaacactgaaaacgagaaccgcaatactggcgctggcgtagatgtaaatacaaatgcaaatgcaaatgcaaatgcaactgcaaatgcaactgcaaatgcaactgcaaatgcaactgcagagctgaacctccccacggtcgatgagcaaagacagtataaggtacaactgctattgcatatcaacagcatattacttgctagagttattcagatgaataatagtttacaaaacaatctacagaacaatataaataatagcaataacaataacatcatcaggatacagcaacttatatctcagttccttaaaagggttcatgccaatcttcaatgcatatctcagataaaccaaggagtgccctcagcgaaaccactgatcctcacgcctcctcagctagccaaccagcagcaacctccacaggatattctttctaaactctatcttctcttggcaagagtgttcgagatatggtagaataactttgtttctcttcccttttttattttgtttttttttttttacttttgcaattttaattttgcattcagctacaggtgtgattgcatacccgcagagcaagtacaggaagcataagaaaaatagaatacgaaaagcagaaaaagaaaggcaaataacaatcactcaagtactacaactgcatgaatttatcgtatgtaatgtacccaacgtaaataataatattagtattttaaaatctatgacatcagatgtagttatcttactgccagccctattaatactactttcttattatcttcttcgagagccaccttcgtcatcgtcgcagtaagcattgtcatcttcatcatgcacgtcggtaacggaagcctaatctcaatatctactagtttactctacgccatttggagcgtagccccttctccttttgactctctgacttttccctcccctccttctcttctggcctagcctaacctagtctagcctcgctggaccccctccttccaacggtcaaccccttcctttctattctcttctcgttctctacgtaaggaacttgtaaaagaaaaaatttggtgccatacagggaaatcggcagtgagacggagcggccgagggtctgattataggggttagttacgctcctactatgacgatcaaggagagacaatctcgattctcattttctttgggacaatacgcctttaaccccccattttcggacatccctggaagtctcagctgattcatttaaatactatcaatttccgtgtactttcggagatctttcagtcagcttttccttcatctttttcagtctaatctaaggaagaagaaaagcacttcaatacgaatagctaccaacgtacccagttcacgttgaacaagcaatagaaaaccaaaataacactgcctgtcactatttctgtgccgaaatgaccaccactgcccaagacaattctccaaagaagagacagcgtatcatcaattgtgtcacgcagctgccctacaaaatccaattgggagaaagcaacgatgactggaaaatatctgctactacaggtaacagcgcattattttcctctctagaataccttcaatttgattctaccgagtacgagcaacacgttgttggttggaccggcgaaataacaagaaccgaacgcaacctgtttactagagaagcgaaagaaaaaccacaggatctggacgatgacccactatatttaacaaaagagcagatcaatgggttgactactactctacaagatcatatgaaatctgataaagaggcaaagaccgatactactcaaacagctcccgttaccaataacgttcatcccgtttggctacttagaaaaaaccagagtagatggagaaattacgcggaaaaagtaatttggccaaccttccactacatcttgaatccttcaaatgaaggtgaacaagaaaaaaactggtggtacgactacgtcaagtttaacgaagcttatgcacaaaaaatcggggaagtttacaggaagggtgacatcatctggatccatgactactacctactgttattgcctcaactactgagaatgaaatttaacgacgaatctatcattattggttatttccatcatgccccatggcctagtaatgaatattttcgttgtttgccacgtagaaaacaaatcttagatggtcttgttggggccaatagaatttgtttccaaaatgaatctttctcccgtcattttgtatcgagttgtaaaagattactcgacgcaaccgccaaaaaatctaaaaactcttccaatagtgatcaatatcaagtctctgtgtacggtggtgacgtactcgtagattctttgcctataggtgttaacacaactcaaatactaaaagatgctttcacgaaggatatagattccaaggttctttccatcaagcaagcttatcaaaacaaaaaaattattattggtagagatcgtctggattccgtcagaggcgtcgttcaaaaattaagagctttcgaaactttcttggccatgtatccagaatggcgagatcaagtggtattgatccaagtcagcagtcctactgccaacagaaattccccccaaactatcagattggaacaacaagtcaacgagttggttaactccataaattctgaatacggtaatttgaatttttctcccgtccagcattactatatgagaatccctaaagatgtatacttgtccttactaagagttgcagacttatgtttaatcacaagtgttagagacggtatgaataccactgctttggaatacgtcactgtcaaatcgcacatgtcgaactttttatgctacggaaatccattgatcttaagtgagttttctggctctagtaacgtattgaaagatgccattgtggttaacccatgggattcggtggccgtggctaaatctattaacatggctttgaaattggacaaggaagaaaagtccaatttagaatcaaaattatggaaagaagttcctacaattcaagattggactaataagtttttgagttcattaaaggaacaggcgtcatctaatgatgatatggaaaggaaaatgactccagcacttaatagacctgttcttttagaaaattacaagcaggctaagcgtagattgttcctttttgattacgatggtactttgaccccaattgtcaaagacccagctgcagctattccatcggcaagactttatacaattctacaaaaattatgtgctgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgactttgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtttgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtttgaaacaccctttttaacgaaatggttatgactagacagacatcttacgtcttactccttcatgctttatttttttctttgtattgtatttgaacagtcaatatgtggtgttgcgacgaaggcatatatataatagtctcaacccaccattttcgaagatttacatacacattatatttttataaacttccaatatgtaataactttatatgatatgtaacttctcactattatccttactattaaacggtttttaataaatatcattgttctttgttttattaatgagaaaaagaaatttaatacaatgtccggcgggaagaaaaaaaatcgatgaattaattgaaaaaaagtatctttatcatgtgaactgaggagaagaacggcatctcgaaaagagcacgtcgaaacagcggtaggtaaaagagggtactaccagaggtcttttctctttatacgttaacctctcagctttttcttttgcaattcaggacactttaacttgtagtcacacgctagtccacgtagcaaagtaaaacagcacgaaaaaagtgattacaaatttcaagggagatatgatggacttagataagattatagcatcactgagagacggaaaacatattcctgaagaaaccgtttttaggctatgtttaaattcacaggaactattaatgaatgaaggcaatgtaacacaagtcgatacaccggttacaatatgcggtgatatacatggccaattacacgatctactaacgctcttcgaaaagagtggtggtgtagagaaaacaaggtatattttcttgggcgattttgtggataggggattttactcattggagagttttttacttttactatgttacaaattaagatatcctgataggattactttaattagaggcaatcacgaaacccggcaaattactaaagtatacggattttacgatgaagtagtaagaaaatatggtaatagtaacgtatggaggtactgctgtgaagtttttgattatttatcattgggggcaataataaacaatagcatattctgtgttcatggtggattatctccggatatgaccacggttgatgaaatacgaacaatagacaggaaacaagaagttccacatgaaggtgctatgtgtgacttattatggagcgaccccgaagacgttgacacatggtcattatcaccaagaggtgctggatttcttttcggtaaaagagaagttgatcaattcttagagaaaaacaacgttgagttaattgctagagctcatcagttagtgatggaaggttacaaagaaatgttcgacggtggattagtgacagtctggtcggcaccgaattactgttatcgttgtggtaatgtagcagctgtattgaagatagacgacgatttgaatcgtgaatatacaatttttgaagctgttcaggcacaaaatgaagtcggaaatgctataattccaaccaaaaaatctcaaatggactatttcttataaatttttaacaggcactctaattgtcaagtgcatttttctttttttcttcataatgcaataaaggaaaaaaaattgtaatattacatacttcttttcacatcttagctaattaacaatatggcttttgaatactaatatatacccagctaccgtttcttcttttattttttattcctttttttcttcagtagaatatgttatagatgcggaggtcccctaagttcttcacgtgttctcttctcatcgcgtttgatatgaaaaatagaaaaaaatacatagtagcatgactaactaataataagctccgctatcaaagatgtcaagtacattaaggaaagcttttagataaggaaaagaacttattaataatatataatatgaaaatatgtcgcttggtataccactttcccaattaatagtagaaagtccaaagccattaagtagcggcatcacaggattagatgagatattaaacctgggattccaggcaaggtcgatctacgaaatatttgggcctccgggcattggcaagactaattttggcattcaattggtgtgtaattcgttagaaggcatacaacaatcggaaataaacgacgataaaattctatggatagaaacatttcaagaaatgcccataaacatactaagagaacgctttcaaaaatttaaaatcgtggaagaaaatgtgaagcgggtccgaataacgaaatttggacagctattatatttcttccagaatttgttcaaattatctcaaagtgtgcgatataaactagttataattgatggattttctcaattagtctgcgatcatctgtgtacactaagtaaaagaggcggcggaatgatagataaaactatacacgagttaaaatgtcgacatttgatattaatttttacggtaatgaccaaatacacacattccacgggttcgacaataatagttttaaatgactgtatgaacaccgccttccaatcaaacgaattcgaatccttggaagaatactacgaaattttagacgacggatctaacttctttgtcaactctaacaacgaaaggcgtaagaacaatgtacatatattgaaaagcgcgctcgttgccaatatcgctatgggaagcaaggattccacttgggaagtatttctaagagacaggatcggcctttttagggattggaatgaacaagtggacgaaaccgttttcgtgaaaagcaaaagagtgaaggcgtcatcctcgcagagtaacgagggatgtactaccatcaaagaaatgagaataaacaaacgaaactttgaaaacttgagaatagctattgtttttaatttacacggcgaagatagaaaaagagaaggacgaaatttaaagcggtcaagaagcagcgacgatcgtaactatattgtcaaatttgattttgataaagcaacaggtcaactccgcgatataattgatctgaaacctgatactgctaatattgcctcatttccaacattatcaacaagcagcagcagttgctcacaagtgtttaacaatattgactccaatgataatccattaccaaatgcggagggaaaggaggagataatttatgatagtgaaggttaatagtaaaataaaaaaaccgaaaaccgaaaacaataaaaaatggaaaaacgacaacattccacccaacaactacaaagaaaagttaagggtaattttacctatttaggattttaatctgttggagttaaggtgaatacgtttttccatattggggtatgcagctcgaacctaaagtggtatgtacacatcccctcaagcacacccattacccttataggattaatgtaagcaacagcttacacggaattggaaatactattcaacgatccatgcatctgccagattcggacatgcatattccccaattggatatagaaaattaacgtaaggcagtatcttttcacaatgtacttgcaacgcggcgacttaaagttgaagtacaacctgcagcagcggctttttgtacggtacgccaaactgtcaatggataatattgcgtagaccgaaaaaggtaatcctcaacactacccgtggtggatgacctaaagcagtaatattggttggaattatctcccagacggcaccgtctccccgagaaagcttagccccgaggtctaccttccatacaccactgattgctccacgtcatgcggccttctttcgaggacaaaaaggcatatatcgctaaaattagccatcagaaccgttattgttattatattttcattacgaaagaggagagggcccagcgcgccagagcacacacggtcattgattactttatttggctaaagatccatcccttctcgatgtcatctctttccattcttgtgtatttttgattgaaaatgattttttgtccactaatttctaaaaataagacaaaaagcctttaagcagtttttcatccattttactacggtaaaatgaattagtacggtatggctcccagtcgcattatttttagattggccgtaggggctggggtagaactagagtaaggaacattgctctgccctcttttgaactgtcatataaatacctgacctattttattctccattatcgtattatctcacctctctttttctattctcttgtaattattgatttatagtcgtaactacaaagacaagcaaaataaaatacgttcgctctattaagatgaaattatcaactgtcctattatctgccggtttagcctcgactactttggcccaattttccaacagtacatctgcttcttccaccgatgtcacttcctcctcttccatctccacttcctctggctcagtaactatcacatcttctgaagctccagaatccgacaacggtaccagcacagctgcaccaactgaaacctcaacagaggctccaaccactgctatcccaactaacggtacctctactgaagctccaaccactgctatcccaactaacggtacctctactgaagctccaactgatactactactgaagctccaaccaccgctcttccaactaacggtacttctactgaagctccaactgatactactactgaagctccaaccaccggtcttccaaccaacggtaccacttcagctttcccaccaactacatctttgccaccaagcaacactaccaccactcctccttacaacccatctactgactacaccactgactacactgtagtcactgaatatactacttactgtccagaaccaaccactttcaccacaaacggtaagacttacaccgtcactgaaccaaccacattgactatcactgactgtccatgcaccattgaaaagccaacaaccacatcaaccaccgaatacactgtagtcactgagtacactacttactgtccagaaccaaccactttcaccacaaacggtaagacttacaccgtcactgaaccaaccactttgactatcactgactgtccatgtactattgaaaagagcgaagcccctgagtcttctgtcccagttaccgaatctaagggcactaccaccaaagaaacaggtgttactaccaaacaaaccacagccaacccaagtctaaccgtctccacagtcgtcccagtttcatcctctgcttcttctcattccgttgtcatcaacagtaacggtgctaacgtcgtcgttccaggtgctttaggtttggctggtgttgctatgttattcttataaacggtggtgtttgacacatccgccttcttaatgctttctttcagtattatgttatttttttgttattcgtttttcacttctaggctttttgacagactagccccgttataccaccatctttgtgggaaagcccctaaattgccctgagcagtatcgtttcatgtctagtctctttaaagatgtttcttacgcgttgcgtgtaaaacatcctctcattcaagacagggttttctaaaagcaataggggtagtttaataattcttatataatcatcatatacactatttttagttcttaattctttaatacaaacttattaatgtgctctccattgatctcttaatcaggaggcgatatataccggaagcggtgtacttttcttcacctcttactcaactatgttgatgtgcaagtttaaccactcgtcgatattatctattgctataacgaaaactttattcgagttcacagtgaaaaacttcagcacatttatggaagatctaagcaaaatggagaacgccagtagatgcgaacaacaaactttatcaaatttgaaataccactgctttgataagctatgaggatccagctgtgcaaacctatcatccgaaaattgcaaatgatcatcaacttcatttattagcacatcgtgtaattcttctttttcgtcagttttttctagtgcttcatgaaagtatttacaaaactcttcacatgagcagaaccagtgtgcgatatctacgagtattggtggcgctccatcattagtatccttcactattaagcgatactccaggagcgaattagatgaacccttataaaattcatcaactaacacatcaatcaatgatgtatgctcattaccttccttgttatggactctatctaatatgtatataaacatgtctgaagattctagtaatgaaattgctcgaataaatagttcccttggaaacatataatataagaaggatgctattgtatcatccagttttgtatcatcgtttgtgttaaccagtttagcaaataatttagagtattctattacatccttcgacatactcacccttgtgacttgttcttttctccctatttcttcttcatcaccaacacttttgctttaccggcttgaccttaaatggttattttttcccgtataattccaatatatcagcgcatcttgctgatattttctgttctataacaatttaataagggctgacaaacaaaagtaatcacttcgacaagtacaaaatgggtctatttaataacttcaagtttaaatatacaagggcgcaactggagatctttagattttcattttgtttgctagcacctgttgctgtaatgtactatattggtacagatactgataaaaaattaaatgttccagggttttggccagatcctgcaacgttgaaccaaataccaaaagagccttatgagattaaagctgaactggcaaggatgaaaaaagaacgtttagagaaaaggcttaggttggagaaaaagatacaagaggagtttggtttagaccttgaggaggaaaaagaaaaaattaaacgggatttggctctcaaaaaaggatgagaaaagaaaacggttaaagatgtatacttgcacctgaccactttttcttccttatatttattattctaacatgtacatacctgtatagtcgtatttccactagatcatcacttcccctctatattcatgtctgacctggttatgcaggtcatgctctattcaaatagtattgaaaaagctgaatgagcaataattactgattttcttcttcatccataggattatatatattcttagataatagcctatttagctcatgcttaacaaattcgactttcgagggatttactaaaagatgggtgtcatccaactcctctagtactatatcactcatcttggcgtcaatttgtaatatgagcgccttgatggatggatcacattgaaccagtgcaccctttcttgctctagccattttttcgttcttttacaaaagtatcttggctttgtctctattgggagtacacttctatcttactgcagtttgctcgtcttttttcaataatacgatacaaaagaaaaattaaaagggctattgagactgttgtaaaatatatatgcaaaataaaaaagcattttaacgaagagtatatacctactattagacattaatgactacagataatcatcagaatgattctgttttggatcaacaatcaggcgaacgaacaattgatgagagtaattccatctctgacgagaataatgttgataataagagggaagacgttaatgtaacttcaccaacaaaaagtgttagttgcatatcacaagcggaaaatggagtagcttctcgaacagatgagagtacaataacaggaagtgcgacggatgcagaaacaggtgatgatgatgatgatgatgatgatgacgatgatgaagatgaggatgacgaagatgagccccccttattgaagtacacacgaattagtcaactcccgaagaacttttttcaacgagactcgatctcttcatgtttatttggtgatactttttttgcatttggtacacactcaggcattctacacttaactacatgcgcgttcgaacccattaaaaccatcaaatgccatagatcttcgatactttgtattaacactgacggaaaatattttgctacgggatctattgacgggacagtgattatcggatcgatggatgatccacaaaacattacacaatacgatttcaaaagacctataaactctgtagcgttgcactcaaattttcaagcatccagaatgtttgtttctggtggaatggctggcgacgttgtactatctcagagaaattggctaggaaatagaatcgacatcgttttaaacaagaagaaaaagaaaaaaacaagaaaagatgacctatcctctgatatgaagggccctatcatgggaatttatactatgggtgaccttatattatggatggatgatgatggaataacattttgcgatgttcctacaagatcacagcttttgaatattccattcccctccagaatttttaacgtacaggatgtaaggccagatctatttagaccccatgttcattttttagaaagtgatcgtgtcgttatcggatggggatctaatatttggctatttaaagtttcctttaccaaggattcaaattcgatcaaatccggtgactctaattctcaaagtaataatatgagtcattttaaccctacgacaaacatcggatctctcttgtctagtgctgcatcgagttttagagggacacctgataagaaagttgaattagaatgccattttactgtgtcaatgttgattacagggcttgcatcgtttaaggatgatcagttattatgcctaggttttgatatagatattgaagaggaagcaaccatagatgaagatatgaaggaggggaagaattttagcaagcggccagaaaacttattagccaaagggaatgctccagaattaaaaattgttgatctttttaatggtgatgaaatctataatgatgaagttatcatgaaaaactatgaaaaattgtctataaatgattatcacctcggtaaacatatagataaaacaacaccagaatactatttgataagttccaacgatgccatcagggttcaagagttatcattgaaggatcatttcgattggtttatggaaagaaagcaatattataaagcttggaaaatcggtaaatatgtaattggatcagaagagaggtttagtatagggttgaaattcctcaactctttagtaactaaaaaagattggggtacattagtggaccacttaaatattattttcgaagaaactttaaactcattggattccaactcatatgatgtcactcaaaacgtgctgaaagaatgggcagatataatagagattttgattacatcaggaaatattgtagaaattgcgcctttgattcccaagaaacctgccttaagaaagtcggtatatgacgatgtattacattactttttggccaatgacatgatcaataagtttcatgagtatattactaagtgggatttaaagcttttttctgtggaagatttcgaagaagagctagaaacaagaatagaggctgctagtgaacctacagcttcatcgaaggaagaagggtctaatattacctatagaactgagttggtgcatttatatttgaaagagaataaatataccaaggctataccgcaccttttgaaagctaaggacttaagagctttaactattataaaaatacaaaatttattgccgcagtatctagaccagatagttgatatcattcttttaccatataagggtgaaatttcccatatttccaaactatcaatatttgaaattcaaacaatttttaacaaaccaatagacctgttgtttgaaaatagacacaccatatcagtcgctagaatatacgaaatatttgaacatgattgtccaaaaagtttcaaaaagattttattttgttatttaataaaatttttagatacggacgactcgttcatgataagtccttatgaaaatcaactaattgaactttattctgaatacgaccgacaaagccttctgccttttctgcaaaagcacaataactataatgtagagagtgccatcgaagtctgttcatcgaaacttggtttatataatgaactgatctatttgtgggggaaaatcggtgaaacgaagaaagcattgtctttgattattgacgagttaaaaaacccgcaattagctatagattttgttaaaaactggggtgattcagaactttgggaattcatgattaactatagtcttgacaaacctaattttactaaagccattttaacatgttctgatgagaccagcgaaatttacctaaaagtgatcagaggtatgtccgatgatctgcaaattgacaacctgcaggatattattaaacatatcgttcaagaaaattcattaagcttggaagttagagataatattttggttatcattaatgatgaaacgaaaaaatttgccaatgaattcctgaaaataagaagtcaaggtaaattgtttcaagtagacgaaagcgatattgaaattaatgacgacttaaatggtgttttataatatcgaatcatcatttaatacacaaggcaagtgtacacttcaggaatgtactgctgaaaaaaaaaaaaaaaaagaaaaaaaagaaaaagatatcttggtttgaataagtaaaattaatagaatccagtttccagtgatcggtacaggctaaataataaatatctctacttttatttattcttttcgttttcttgtgttcaggatagatcaaagagcagtcaaaggtcatcaggaaaatgataaattcaaaaaaccgagagttaaaggcaaaactacaaaaaagagcaatgaatatcgagatcttattaagtttatatctaaaaaaagcctgtgttaccaggtaagtgtaagttattagagtctgggaggtttgaaccaccagtcggaaggtccaagttattggcggaagttgcagctgcagctgcagccccagatagaagggtttctaaatggtcttgtgcattcttactgtttattttaatgctttcgctatttaattgttttctagtctttttaatcctttttaaaagtgtcaaataattgaaattaagttcatttattgtttctttcgtcagtgatatttcgtttgattctgcatgtttcataatggtactcaatgatttggcgatatttatatttgtttgtaagttacttaatattgtggtggaagagggtgacataccggaaacagcaccttcaagatgttctaaagctgatggcgatgacgcagaggaatttgagtctatgggtgcagatataatagatctcgctggagcgcctgttgagtttattgccacaggagatggtgtaattgaaggagacgaagcttccgcgacggacgccgaattatgttgaaagttattcagagaattttgagatatagcatttgaggaattaacagaatgtccgctttttgatgtgtcgctcagcaacccattcatatgtgggacatcaaacggctgtgcttgatttcttgactctagaagggcagtcgttatcgagtttgaatttgccatggccgtgcttgaaggaagttcatcagttgatttgttctgatctgaggcagctttttcgttgtttctgatagctgaagaaaatacttcgctaaaatattctgatgatggtagttgcatatcaacgccaacagtagataaatccaaatcaggacttaagaataaattaggtttatcgattaatgtactgacattataatctaatgggcccggctgtttcattgtattatatggatcattcaaaaggccgttaaaattgacgtcataattaccgtcaacaactaaatctgtagtcgaagagttcctttgcgattccatactagaaatatttggttgtccagggttacctgttttggtactattatcaacagtattctgttgcaaatactttacgctactatcattatcattaatattattactactaccattattattgttattattattactgcctctattattagtattttcaatagcattgttgctgtgattactgttgtaatcggggttgtggctagcttgtgacatgcttaaatgattttgattattatcatcttcattggcaaaaactgatacatcaaaattatcatcatggacctcattaccttttggcgcagtatcaaaatcaggttcacaaggctccacaatagcactttccactaattcttctgtactcaagaagtttgtgtttttgttttcaatgtttaaatctaacaacatttcatattcccattttttaacacagtagtattcatcacataatctattcaaaacgctctctaagacttcgtttttcttaaatgccatactaacattctcattcaaatgtatcatttcaggaggaagcagaccggaacttttccaatttgctttgatagcatcaacgggtatatcatcccaagcttttttaataaatttgaatgcatttgacattgtgagttgactctgctcaaagctaatcaaacattttttaccattgggtatgcattcgttccgttctgatttatttttattttggatattcttcgaaattctattttgcaagtcaatgagcgcctgatactgttgtattctgtatcgtgttttgaattcatcccagacaccccagttaaatggcaaaaactttgaatttgaggaagtgtatacaagttttatattttgaaggcgcaaattaattattcgatgacagcaagaatcatccaaaacaatccaaatcttcctattcacagcaaccaacctcttatcccacctgactaaccagttgtggaaaagattgctcgttagccatgctttcctgttactatggtatgagatatcaaatttcttagccatcttagtacccaacattgattgtgacacaggatcattcggttcattggggaaataattcctgaatgatttgtaactatcatatttgcccacgacaacaggttttaacttttcagagccatctaaattggagcacagcatgacagttgccacctctatacgcctttgaatgctacttgcttcatattgagcataatccaacggtaggttgtaggagagaaacgcttcatctaaagtgaataaatcctttggaggaattttggagaaataagccttcaatacatccctctcttcaaatgtccagacttttggggttttgggtaactcttcgtctaaaacagaaatattgacatccatttttgataaaaaattcgaaatccatttataactaaaagaaccatttccctcgcgatgctccgcaggaattctgtgccaaacagcttgtgcagtgtcttgaataataggtgacgttatagggattccattccacaaactttgagaaatccattcttgtaaaattttccgaaccaaaagattatttggcttccttaatctattcgcatctttttcatgctctttacaattcatataagttgatttccttgccaacaaacgcgatattgtgccttgggatggaatttttggcagctggaacgtctcataagcccattttgccaattcaagttgcgtccactttgggtgcctctccgccattagacaaatattatatctttgctgaatggaaagcatgctggttataataaagctgtctctttactgcttggtgttaccacaaaattcaaaacgcgaactagtcacgattgatcaaactttgctgatttcattcaaatcttgcaactgatttttaagcagctattggttttgataatttcttactttcaagtaattgacttcgatgggcaaagtcactcagaacggaaatatgcagcagctattctaacaacaaaaccacgaatcacaccaaaaagaagtatgtaaaggcatggaaaaagaagtaagcattggaatatatgaaatcctgcttgttgatattccatttctgtgcgaaaaaagagcaataagctggcttttaataatgggttggagccatggataagtacggacatatagctcatcaagaaggcgatgtttgttattatattccaaggctgttcaaatacaacagttattatagtgggacagaggacgttcgaatatttgttggagatttaaagtaccggatgagagtttctttgcaaatttgcgaaaagtattatgataggcggttgtcgatgttgttctggaaaaatcatcctttacagcaaatacaccttattggctgcatcattggactccagttcaaatggattgggaaacaagaatacattttttttcagttggacgattgtacttcagactcttcattggtgggttatactagtgacatgagattcttaacatgtaaagttaagaaggatagcatcctatcatgggggttgaacataaccgatttgataggcttaactcttcatgtctacgggcaagcaagtttgaactatcaagagcttcaagttgaatatttaagattatgctacagtttaacggaagaaatagatcattggaaaatcacaatgaacatgcgtgagcaacttgacacgccttggtccttaagcgattttgtaattggagaattgttcacgcaagagcaagagtggacacctgagacatcacagattgaggtagtaaacccggattttgtaggtatagggtacaaaaccccagaaagtaaaagaaatgaaactactttcatcgagcaactgcaagaagaacgcttgaaggatgaattagaaattattagtccatacaatagcacagatacttcgaatagtgtgcattccttgtcatttcggtttgtatcgtcgctaaaggattttcctgaaactcactttttgaattcaggtgatcaaattgacaacggcaatgacgaacagttaaaaaaactagaatatcaaagcgctaatctacctgtgatgattcccaataggacatcagcaaagtcaaacttgatgttgatcctattaggactacaaatgaaagagatttctaattctgacctttacaaactaaaggaagtacgcagcgtagtaactagcttagcatcgtttttgtttcaacaacaaaatgttggcgtcatgaaatcttttgactctttggaaaaggaagcgtttcgagacctggttaatcgtctagtcagccagggtttgatcggattaaaagataaaacaagtgagacatttgatttgcttcctctaaaaaatctttttgaatatgctgaaaaacgtatatcagttctaatgaagctacaatgttatacaggcactgtgcaattaagtcatgttcaggaaaagctacatttgccgtacataacaacgaacggcatcgttgatgttttcaaagaatgtcttaaaaggacaaagaaacagtatcctgaggtactaaaaaattggtggattgatcttgatccgaagaatggtatggaggaccaaaacagtggaatattattacatttggaatacgcagcagcatattcataatttgttagaaaactcgcatcgtcaataacggcgcatctctctaggcctgaaaaattttgcgatgagctcaaaataagatactataactttatgcatatattgtatatatattatatcaaacaaataaggacgttaacgaaattttatatggccttatttaacgtagaaggttggtctattaagacaaaaaccgtcgcttttgataacaagactaataagtcttcaaaagataaaaaaaaaaataatagaaaaaatggcaaacttacaagagaacagaagttgaaagaagagacagaggctgagttgaaggaacaagtggaagacattccttccgaaggatcagtagccaaagacatcccaaaaaaaaaccaagagaaaagtgatcaaaatgaaacgagcaagaaacgcaagcacgatgaagaagcccctctgatgcaagtaaaagaaaatattgaaaaacctacaaagaagcaactaacccctttacaacaaaagatgatggctaaactgactggttctagatttagatggatcaatgaacaactgtatacaattagctctgatgaagctttgaaattaataaaagaacaaccacaattatttgacgaatatcatgatggttttagatcacaagtgcaagcatggccggaaaatccagttgatgtttttgttgaccaaattcgttatagatgcatgaaacctgtgaatgctccaggtgggttaccaggtcttaaggatagtaaagaaatagttattgctgatatggggtgtggtgaagctcaattagcattagaaatcaacaattttttcaaaaattacaataagaaagcgaagaaatatttgaaaagacgccataaagtccacagttttgatttgaagaaagctaacgaaagaataactgtggcagatattagaaatgtgccgctaccagatgagtcctgtactatagtggtcttctgcctggctctaatgggtacaaatttcctcgatttcataaaagaagcttataggattttagcgccaaggggtgaattatggatcgcagaaattaaatcaaggtttagtgacggcaaaggtaatgaatttgtagacgctttgaagctgatgggattttttcacaaaaagaccttcgacgagaataagatgtttacaagattcgaatttttcaagccacctgcggagattattgaagagagaaggcagaaattggaaagaagacaaaagtttattgaagttgaaactgagaaggaagaattagaaaagaaaagacggaaaattgccgaagaaaatggctcttgaagccctgtatttataaaagaagataacgacttcatccgtcattttcatattttaatattgttttttcttttgtatactatatttatacatataattgtattcttttcctgtagtacattgcgtaaagtaaaaatcatctagaagaagtactccacaatgttcacatgagggacaaggttttattgtctctggaaaaacgattggatattagccagccttgaaagattttcaaagcccggaacagaaggaagagcgaaccaattattagtatcttgaccgtcagattgtccactattgggctcccatctatcgcaacaacgaaatccatacgtgttccaggcggtcagacacattgcaacaatgaccaaaatcaggtagaatattttcagtcttaaaagacacaacacagcgaagacaccccagattacgggtgtcacatacatcgaccaccagaataacttagaatcgatggcatttattggtgggcccggcgcatattgcttatatgattcgaaagtaaaattagaatctttgttcacatctgtagaatcataccaccagcgtaattggaccagtttccgacctgtaatgttttttgttaagtaaaagtcaaaagaaagtaaaagaacgacagtgatgaattgaggtgtgaaattcaaaaacattgatcctatgatataaaatacaatgggaactgccttacctgccagatgaaatgatagtagcaacgggtgcgacgattttaaaattgtgttgtagaaatttcttgcctggtccatgtttcattcgtaattagagcaccagcaggtttataaaagcgtattgaaccgtaaatcctttaagaaccacgcttttctacatttacattatgtacagttaaaatggaaacgaaatcccttttcacccaaaggcgcattgcggacaaataataggttcgaggtcaaggtaaacaggaagcaagatgcaaaagaagtaactggaatggaatgtatacattgatatataaatatgtatgacgccttctattgcaaaaaataaactggattatgttacgttaataactcaaattaaataatgtgtaaagcacttgctgttctcatggacaaccatctcattttttttgtaagagttaagttcaagtttgatctcattcatggcactattcatgcttggatgtactttcatcatccacaacaatctgtggcgattcataatgaattccggattagctctctcatatgcattcgatgaccaagtgcttgctaaacatacttcttttgcaaaccggacatctttttttattggttttggaggtgtttcgactttatcaaatgaggaatctggcagcgaattccttctatcttcgaatctgatatactcccagtcatttctcaacctatttaccatgtcgttcccaacatgcattggtaagcttattggacctgacagagactgtcgcaaatctgtcgatatgttgtagaagtatcgtgcagattcattgtcatctaatgaaggcctcttggacgatcttggtggtggttgatttctcgtgtcgattatatattcaccgagctttgaaaattcttcgattatggtcttgtcgatcaaaccttcattgacattatgcttttcggtatctcgaaaagaaaccttgccatcgtcgttgtgcgaggtctcgtggagcttttgtcgtatttctaattgccttcgcctcaaatcgtatttatcattttccttggacaacagatcatcaaaaattgaatctgtatccattagagtttcgtcgtcgtcaaattcaatgccgtccagatttgcatccattaattcaatatcattctcagcttcagaatttccatcagaatgcgtaaccatatcatcgataggaattctccttctttttgtatccttttttccatgctttgtattcgagtttcctgaagtacgccataatttcttcaaaacagaacccagtttcaacttcgattgtgactttatacatctatatttctcagtgcccagaatagtctttttctttctatcaaataggcctgaattagttgttggcttagttttttccttagttgataaatccaatttttctatatggctaccatgtttttcatttaccgtattttcgaagcaataagatatagttacagttttattttcataaccgtcatcatcatcagtttgactttctggcaagctggtcagggtattaacagcagatatcggagaggttgatgaaaccgaactttttattgttgaaggaactgaagtgttcagctccaagctatttacaccgtagcctgtatcattgggaggaatatgtatgactgatgtcccattatgaggccccacaaaatcttttgataaattgcgacctttcttctcgctgaatttgaataaagaagagtctcttgaatttaattcaggctttttcaagctgtgggtgcattttccatcaagttttggcttgtatatttcgccattgggaaattgaaagcttcttttcattttagagcgctgcagttgataaggtgttaattctttatatactccgaaagtgtactgtggcttctggtattggctcacataatcttgatcattattgaacccctcatggtaagagtttctttccctaactgtgaatagcgcagttctctttctttgctgggcggctgtcattgaacaggaccttactggaaattttctagctgctgtcacagacctacagtctatctcgccactataaatgtgtctcttcttattcgggttcgaataattgtaatcagcatcattcctaacattgagtttagagaatgtactagacaaagcaaacaaattcgaagttgagttcgacctaggtatcaatcgctccggtatgggttggttttcttgtgcagatagatatgagccctccattattatcagcagtttgtggtaacacctaatatggcctatctggataatgagatagccccttccctttttccagttttctttttcttttgttcctatattatatgaagccggtatatatatttatgtagaataagcttttagcaggcgtcccattaaagtcgtcaaggtaagtcgggcccaataaacttgttgaaagggtgagagagaaagtgctaaaaggaagccaaacctttgtgaaacctggggtatgtcgagcatataatcaaaaataagacgtactactcaaaaaggaaatgcatgggaaaaagaggcagcgaaaaaggaaaagtgagtgcccatctatttttaggcgctgttccgttcagggatcgtacttgtttcatatcagtggtagcaacgtggtagcacggaagaatttgacaaggagctaaacgtcatatcgccaaggaacggtttttcgtttcaaggtcgttggagagcttttccatgatcggtatggagcttaaataaagggaaaggaacaatgatacgtttatgcttattcggcaaatagaaaacatgtttaatacagaaaatgcagtaatattatatgggaagaatcaagactcttgccttccacctctttagagtaaattcttatatagggctgaacatatacacactataccgatagaaaggttataatttaaagggaaaaatgcacataaagaatactacttaattttgatttttggttctggtgccgttgtttttattttttctcgtcttttatctcttttaaacaataacgtatctgattggaatatgaatcaacttgatggcgtaaccaatgataccgactgcaataaaaccaataccaacagccttgacaatcttggtgtattccttcaaatcaggtttcttacacttggccaagaattgagtaccttctctgacaaattctacaggtgcttcaaccagcttttcaacctggttgttgctctgctttttctcttcacctttttcactagctctagccattttatttttcaatgttatacgtgattttatctttggtaaactagcgtagtgcggacaatggacacgagttatggacaatacacgccaatctgtactattttccttgtttaatttaatcactagtattctttcatttcaaaacgaaaaaaaaataaaaaaaatgttgcgaggaaaaaaaggcgacgtgtttcgcattccgccaatatccacagagggtaatgaatttttcgtactatagatatacaactacaatttatatgagcgacttacgattacttacatactaccgccaggaagaatcaaaatcccttccactcttcctcttcctcttcttcagattcgttactggaatcattatgttgcgtttcgccttcaagaatatcccaggaaacaagtctggtgtcactgaataggtcttctttgatcttctctctcaacaccttactgttattgtaatctgccacgatatcttggaaaattgcgataacatcggctagtggcgttttttttgcgctctctgcaattttgcgcatctcttcctctttgttttcctcgtcttcatcgtcttcatctccatctttaagcaatctttcccattcgtccagcagaatatcgacgatatgaattggaatccctgtgtagacctttggacttccactcagaggtaaccacctcaacactttcttaatatactcgtcgactaattttttgtcccagtttctggactgcaaatacttcaattgactgaataatacccttcttatcaatagaagatacttatccaacctatatctgtcaatgttaaaccattcaaagcacatgaccttccaaaaccctctgctaaactttataaatgctttatcgtttgtggtcaactcatctgcagtgctattgtccttaggatcaaaatataatccatgcaattcacctaattcattggctaaacgttgctgaggtctaggacggtcactgaaccacattgcatagtaaagacccttccaaagtttattgaattctatttgtttgttctccttgaactgtttagcggttagatatttctttaacgcttcgagtgcatttaccctggtttttctgttgttcgacgataattgtttaacaaagttggaggtctccattgtgaatgttctcactcgattttttaagtgtctatttagtgtattatgccgtgaatgcgcaagatatatacgtatacttaagaatgtagtttatatttgacaatttttttcagctcatcgcatttttttttctaaattctttacctctcgtgctccgtgactaggatattggaaattcaaatgatataacttaaccatataaatcttttaagtggttccgttgttcctcagattgctttgtaccatctactttcctagcttccagatctccaatgctgacaatcttgggctgcttggtttcttcttgttcccgttttttcttcagatattcatatttagtaggattggcgactaaaacatgttgtactttttccttatcctcaatttcatcacgtatacccatttccttagcgtgagatctagcaaactggttcaattcgtttaattttaggccttcacctgtcaaatgtctgcggaacatttttgatttttcatcaactgcgcccagtgtttcagttttgtacaatcttgatttaggatcataattactctccgttgaatttatgtcgttcaagtaagcagccttatcttctctcaatctcgttgatgtcctatacaactgagaattatcagcatcatctttcttcaatgaacctacggaatccttgtaaagttctaacttcattagttctatctcttcatctgtatcccatagtgtttcatcagtttgggatttgtcttttccttttattttatttcttttatcacgctcccacttacttatcagttcattgtattctttccctgagtaaccgtaccatctatcttttctggagtcccagtcatcatcagtagctcgtactaaaactgtgccattatttttttgtgaatttaaatcgggaacaagcttctgcatcttacgaggtttttccatgcagtctttctccttatgccctgcttccccacaattcctacaaaatgacagcgaatgagaatctcggacggacatcttctggggtctgattagtttgaactcatcctttatacccataccaatttttggttctgaattattgtcaatatctaaagcacccccttttgctttttgcctatgatgcaccaagtagtcgcttttttctcctccttctgcagtgctcgtatcatcattgccgggcttcttcccttcttgttctttgggggtatccttatagtaccatggttgatttctaatatacctggggatatgaatattttcatttttttcttttgcttgttgtagttgccttttatttctgttaatagtgcttcgattttcgttgtttctgctgttattattcattatgtaatccgatcgttgtatttcagtgtaactggtatctttttcagaagtgctcgataaatgatatacgcagacttgattattgatttacttgaaaggcaagctattcaatagataacgaaggagttatcgttatgggtactattattgtctttccgcgttcgaactagtcactagttgttccaatgaaatgtactttaaaaaaactcgacaacttctccaattaaattgaagagtacggcagctgaggttaccaactcttttctatattttaattgtcactaggtataaaaatcaaaagtctagaaaaatgtataaaaaatcttccccgccaggacttgaacctggaatcttctggttcgtagccagacgccgtgaccattgggccacgaggaacaagatttcttgaagttattgaaatacgggatttgctgataccagaattaataaattcagaccgacttctcttgtggggtggtaatcatcatttaaagtgtggtatcctgcttagcccggacaaagaagttattttaaagatttatttgccaatcttcacaactgccctgttgtatctatatattattctgttgaaacaaagttttaatatagtctactaactagtattcccgcatttctcatattcctttgaaaataccaactatcgcttattttaccagcagttaattaactaaaacgttctcatggggatggacaccagttaaagaatcaatagaacctttttcaaatctccatatggagcggcctcaatgagtagcaacgagggaaataattacttgcttcggctgcattcagtgattagttaaaaagtcgtcaccctaagtttttctgtcgtattttaggcattttcattttgaggaaatatcgtatacctggtaattgcctatattttgagatgaagactgtttctcatttctttttggtcatctccttgcagagcatttgataatatagtagtaataatgaattgtagtcgataaatgttagttgattctcattcctatcgtatcgataaggaaacctgagaaataccaaggttcaacgataatggcaaacatgcttcattaatcggtattcttgatcaaatacttccttgcctgccatacggcatcccttaatcgcaaaatagtaatattctttccaactatataaccgttattttaacacacatttctcaagagacccctttctagaaatggcatggagtggcaagtatcttcaagctattttttagttgttcatgtactccatagagtgacggttcttgcaatttcaactagtttcaagatagtcataaaaatttgcaaccgagcccattactatatatatatatatacaaaaaattttaacattaaaccttgagctcgggttttatctcataccaagtattatcaacctttggccggtgtgttcctaatatggtatcgattttcaagtataccgtgtaacatttggtttttgaattatccaggggtattgcaaggaatatcgtggatcctgccatatgaaggcgtggatcttaatttattcacctttactgatcgtaccaaacgaagtaagcgtagaaagctaaccaatttcctcttgttacagagagaaaacttttcttgtacagtaaactgaatatgctacgtcgtagacttacaatgacgccgcacttagggatagtagttaccttgctcactttactgtcgtgatcattacacccgtacgtaatcgatgatcattgcaggagaggggcactttggtctgacatcactttttttacctaatcaaatagattggcttttatttgacagataaggtttatgatctcttttttcgaatggaaagttccatgcaggcaccctttatctcattgtatttaaactacatatagaatggatggaaacgtggcaagtcatatcaggacgctttgaagactgataattaaaaacattaaacaagtttccagatatcaggaagcgaccaagccaatattcagaactttcgtttcgaaaaacacagtaatatattattctcaaaaattaccacactttttttaggcaaggctgcaaaataataccagaaaagcagaggcggttcttaacttctgtgtaaattcagtgcaggaggacgggtgttgtgttattaacttgcaaggaaaagaaagtttgtgtctccccttgttctacgctagcgaaatgggtgtgtggaagagtcaaaactgaaccaagaaaaaaaaaaaaaaaaaaacaaaacagataaaaagataaacaaaggcaagatcaaaaagccctatcgtgaacgctatcaaaggacttttaaaattcataaattaatagttcgtccgttgccctcttgaatataatagagatagagtttaatacttgctttttacctttgctttttttttgtatatctccatctcagccctaggtaaggatagatacgaagggttgtacaatcatgaaatttgaagatcgcatattgaataaatcaatccctgaatggaaattctacaatattaactatgagaagttaaaagtagccataaaaaaagtaacggcttatgattatgacaatccaaatgattcgggcatggagaagttgttgaatcaatgttcagtagcctttgaccaggaatttcaaaatgttaatttatttgtttctttgaaaataaaggaaatttccactcgtattctttctgtggaatcatcaataatcgatttttcaaagggcttaaacaaaacttccagaaaccgtttcaaccttcgtaaactgaaaatcatcaacgctcatgtagacgattgtaactttgaactacaactactgtcaaggtttttgataatacaaaggattgccttgagaaagttattcaaaaaattactaaatgaatttcctcaagacagtgaaaatccattgactgcaagtgagtatgttacgtcgatcagaaactctgaaagtttacgaaatggacacgaaggcatatcatttatgaagcttgatttagatccatatcttttagaagtttcgctaattgttgatgttttacatgatttggaaaataaacttgaagatgcaactgagccagcagtggagcaaagatccctaaaccgctccgatgaatctgcccatacaagttcaagtccagaagccaacaattcttccttgccagcatctccaaggtcaattccgctactttcaaacaagaaaacttcaaaaatgattgattcttcgctagaattcgatactgccctcatagataaagcagagaatctaggaaggtttttattatcgtccgaggacatagagggactgaagttcatgctattgaatattggttttaggataattgacgatagcatcatatccacttcaaaggagattttagacactacagataatattaattctgcgggcaacaaatctataagatcagcaaagtcattcaatgacttacaacataccttatccctatctaaacagaagaacatattaccctctgctgtacaatccaatgagaagtacgtttctattagtatactagatactgtcgggaacgaaggcagtcctttactacttactgatgataatataaatcagcacccaaacatgatagtcagctctactgctgaggatacttgtatagtaatgtgccacgtgggcggcttaagaaatcatgttgtcacaaatgatctgcttctaagggatgtaaagaatattctttcggccatgaggagtggcaacgacacaaaaaatattagcgctctcataaactcactggatccatcgccaatcagtaagatcgctttggagtggattcagtcccatcgattaaaaaccattgaaccaaagctagattttaaaagaacaagattcatatcagcagacaatggagatatatacttgatagctttggatgaatctatcactattggaaatgtatctacattaccctttccaattttagaaattaaaaagcttagtcgatccagtggtctttcacagacggctattaatgaagacaataagtttaaacagttaatgaaatcagttgttacaaatgagtttcaatgcagcttaataccaccagacttaaccacatggaaaatatgtttagaattagtacactcaaatgaattgcaaaatgatttatttcaacttttactaagagatcaatataaattaaattccgatgattcgctatcacctgatgaatttttccagctgggcaaggatcgtctagaggaagagtttgacctgactgggccgataaacaactcacaaggtagtgttgacagcggcagaagagttcgaattcacaaaaaatcaaagcaatcggataatgaaactaaaaagaaacctattaggtattggaatgaatttgatgaacaagaagaggataatttagacaatgctttttacattgatactaatggaagcaggagtacaacagataacgaagaatccttacttttgagaaattctccgcctgattatgggtttattttgtttagccggaatttcatcaaccgcacatatgatttttgtgagaagttacgaaacttgattcgccatgacaagaaaacatcgccagatttgtttcaaaactctaagcatccgcattgttcatcaactaactatggttctgttgcgtcatttggttcacaatcaacttcagcgtcatatgatgacgttcaaaggtacttacagtatcaacagcaagacatagaggactcacaatctatctacgaatataggcatgacgaagttgttacatttttatacttgtctgcactgctaacatcttgcattatggcaagtgtatgtctgggaatcgttttatccttgtttcgcgggcaaagtaataatgagatagatttagaaattcaaaatattctcatagccattattatcatttccttactggtttcccttattttgatctgtgcgtgcctgttgttgttatttagtcggttcactttggcgccaatctggcattatgttggttgcttcacaatgtttttctcagttactggaacagtgtgctatggtatgattgaaattttcttttaattattttggacgataaaagtttttcatgtgtacagtctatataaaatatgcatatcatgtggttacataagaagaatgttaatcttgtttggagattttgtttttggaaacttcgccattgcgaagggtgttgcaaactgaatttctgtttaagtttttaattaataatccttattttgatcttttctgatggccgtgtttgaacgcatagtattgtgaatataagcgaagtgaaaacctttacacctgcggcagatgccatattactgcgctagtggtgaatattattaagcgtgctatcaaaaagagatgaaaacgtgctaactaaaaaggactcagattcgttacacacttagcctcgaataacgatcaggatctgttctaaccacaactccatggacagcatgcaatgtttgggctcttgataacgtccccccatcagtactatcgtatatattaaaatcgtctgcaaagctcgaagcatcgtcggggattgaacagttatccaggttatagttagtaacatttcggtcactcttgctaatatcttgttcgattttttcatcgggttcttccttttgagcttggccactttcttcgtcaaaagtattgcctttagctaggaatctaaacctacaccaccatatgaaatgagacgcgaaaattcctaactccattccagcaactattgagtataatataatacccataatatccatattacctaggataacactgatgatagatagccaagcacctaatgaatcgatgaataagaaggcaaagttgatgccaataacacgacctttccttttggctagttcaaagtaaggtggaagcagtccgacagctaacaaaacagatgcagaaataccaaaaatcagatcgggccatttaacacccttctcgtaaaggggcctcagccataatataaagccaacttccatgccaacatcagccgcaataatagcagctacaatcattactattttggatctcgccatactgattggtggataataacacgattggacgaaacttatagaacagaagaacataaaaaggtgtggttgaacttgtaaaatgacattacctttactaacacagaaatatatggcaaatggaattccggaaacaacccagaggaacatcatcagtggtggcagccccgtacagtccttttttttccaattatatattatttgcggaattagctggacacaccagcaaactgttgctatagtagctaaagcggtagcagccttttcagagatcatgaataccttattcttaaatctatgttatgttatagtattccacagtttatatttcagcggttaatttgaaaatagagatcagcggaaagtagaaggcaccagaaggaaagcattatttatatgagtttcgtttggtacgagaagtgtgatacagaggtaatctacctatctagtcattgaaaaatgctatcaagaaacggcgttctcatattacccgaagcaccttatctggcgctcacaccgcggaaataattgggtgatattttagacaaacggactttaatgtcatgctaagataaacgttcagtaatgcagcaaatgcttatcatgacgactcgtttacaaggtaaattcgattacgaagaaggtgcggacaaaataacgattaattaaaatacaataggtatataaaataaatagagaataaatatagtgtagttgctttacagaaaaatgaaataaactggagtacggatcaccgaagaggaggttgttcactttcaggttatgatgtaatgaaggtgggaagttagaaatgtattagttggcgtatatctagaaataaacaacccgatgcttgggaaggaactcaatgtaatataatactcattttgttttgcaaaaacattataactcttaattatttctccacatttctaaacccaaaaataaaacaatcgtcctcttggttctccgaatcccaagatgcttaaataccggtgttatccaagaaaaagtagtttcctgatgatttttgttctttatccatttgggaatctagcttattaattcttggtctgaaggagtttggatcccttctgaaggtgacattcaaattcttcaaaaatctgttacaaccagtcaacaaagattcaggggctcttgcgtgagcattcttggaaggaataccttcaaaaacaatgaccttatcagcaagataagtagccatgatgaaatcgtgctcgacaataaacgcagttttcttattatgtaagatgaatcttctgataactttagaacagataatacgttgttcggaatctaagtaggcagatggctcatcaatcaagtatatgtctgctgggatacccaatgccaagacgatggcgactctttgtaattcaccaccagacaaatgttggacttcttgatcaataatatcgtcaatccttaaaggtttaacgacatcagtctgaaactgtggatttaggaattgtcctctaattttcttgaaaaacaattgtctgacagtacctgggaactttggtgcaattttttgtggtttcatagaaacattcaattttggaatatcttgtccttcatctggcttcaaagcaccagctagtaatttgatcaaagtggtcttaccggtaccgttttcacccatcataacaaggatttcggaatcggagaattcaccttcttcaacattcaaaacaaaatcaccttgagttttcttcaaacttgggtaagagaaggcgcgactagcagagtcattctgcaagtcttcggtagcatcagctattctaaattgtaaagcttcagttctgaatctcaggttttcagcaggaatatgaccgtccaagaatatgttgataccttctctgacagaggctggtaatgtaacaacaccgtaaacagatggaacaccatatatgatacaaacgaaatcggaaagataatccaaaactgacaaatcgtgctcaacacaaataacgtatttagttggagctagtaaagatctaataatttgagcggcattcaaacgttgcttaacatccaaataagatgaaggttcatcgaacatataaacatcagcctcttgaacacatgacataccaatggcaaatctttgcagttcaccaccagataacttttcaatatctcttttcaaaacgttttccaactgtaaaattttgatgtagcgtttcacatcttcaggacttttttccattctcaatttcaaaagttcgccaactttttgaaccggacctttaatagcacgaggaatgttatcaacatattgaggtttgattatagccttgatatcatcttccagcatcttggtgaagtaattttgtaattcagaaccacggaaatatttaataatttcctgccattcaggaggatcatcaaaacgacctaaattaggtttttgtttaccggctaagattttcaaggcggtagacttaccaataccgttggtaccgactaaaccaaggacttgacccggtcttggtgttggcaatctgtgcagtttgaaactattggcagagtaacggtgagttacatgggcttctaaattagttggcaaattgataatttgaatagcatcaaatggacatttcttaacgcaaataccacaaccaatacacaagatttcggaaatgaatgcgatttttgaagttggagtgacttcaatacataatttaccagttttcacaacgggacacgaacgtttacactcttgacgacacttttttggtttacatttatcagcgctaacgatagcgatacgactgtttttatcactcattatggtctgtcgtgttttcttaagaacttttgcagaaggctaggtggaattcgcgctgaaacagatcacaatgaagatctaagaatacagaaacaataaaggttaatgcccagttttacattttttttttttcactttcactttgctagcgagcgatgcgattgagaaaaaaaatagaaaattttttcagttgcaaaactacccggctagaaatctggttcgatgcacacgagtaacaagagattgtttttctatccatggtatttgcttatgaacaggtgactgaagcagcgtatagtcatgttcagtctttactatgtgaagggtaggatgctaatgaccggctctttcttatcctccgcggtgttttaaacgatgctcctttcaagtacgctattccgtactattttttactgtgataatttgatcatcaacaacgacgaaaatgacacgtcggcggctaatttgatatttctttatttgtgtatttccgttgcagatacgagggcgttttacatgacatcaaactattaggaaaatccttttccaattcagtttgtagtaaaccatgataggccacaagacattttttttcaactggggagaaatttaacaaggacgtctttttttatttagacgataaaaaaccaagaaacaaaactagtaaaggttcttggaagcatttatctggatgcaaaataatcgttattcttgggcatgctgacaatgctgaaaaagttatccaaacaaagtagtcaaatattcaagatcactattagatcgctaaacattaatttctcattttgcgacgatactttttttacagaatataaattcatgttaattttgagatatttaagcgtttcatctctttttttctgggctaaaaaagcttttcgatgtctagaaatactaccaacaaatacttgaatgcagaacaagaaggaaaaaagcttgatactagtcaagcttaatgattagattctgcgggagccgcgggaacagaaaatactaacgttttaaatatcatttaaaaaattaccaaagtacaataagcagttttttctttgccttctctacatgtgaacaaatataatgggcatctaacaggaatttgttttcctttaaaccatcaaagagaatagttcagttaattatgccgcatccgtattgttacccgaaattatggtgtttttaaaacaaaggataagtgattcattgaaagatggcgcgccaccacgaaccaaaacacctctatagagaatagtactttacactcttctgttctttttttttccaatattagcaaataaggtcaggttcattgtaacatagttagaaatggcatcattacccaagagaataatcaaggtatgttcaaacaagagcagtggattatatacgaaatctgaagtgacgttttcgtctgagccgtcacactctacactgtttcctcttgataatggctagaacttacatactaacgcaaaacttccaaaacaagaaggctttttttgtccagtttgtagcagcgttccgccttccctttgtccatatccgcaaacgctcatatggagggaattcaacagaacaaactactagggcagaaaacgcaaagtctttgtgaactttcatataggaaactgagaaattagtaagtgacccagtacctggcattacagcagaaccacatgacgacaacttacgttacttccaagtaacaatcgaaggcccagaacagtcaccatatgaagacggtattttcgaattagaattatatctgcctgacgactatccaatggaagcaccgaaagtacgttttttaaccaagatatatcatcccaatattgataggttgggccgtatatgtcttgatgtgcttaaaactaattggtcacccgctttacagatcagaaccgtcctgctgtccattcaagcactgttggctagccctaatcctaatgatccgctagctaatgacgtcgctgaagattggataaagaatgagcaaggtgccaaagctaaggctcgcgaatggacgaaattgtatgcaaagaagaaacccgagtgatcatttctgtataagttttctcaactgaatatataaatatatatcattactatgctgctgctgctgcaaaaaaaaaaaaatttacgataaatgcaaaaaccatagatggtcatctaaagaggcgcatttctcaaaaatgtagcgtcgctaaaatggttttctctacctttagttttacgccagatttttactagacgcgttttagtttactttttcctaccctgttcgttttttttttttttttcgcaccaaatttttcaaccgttccatggaagccgggatcgaccgtcctacactaatgtaagcattagtccgctcgagggtccacgtttaattccggatcataaagtttttaatgtatttcttgttattatcgcttttgttgatcttacctgctattgcatagagacagacaatagacaaaccagattcatcgcttactcggtggtttacctcttagtattactttcgctgcttctttctgctgtgacagagtctcaggtgaaacaaattaatcaaaagagttgattaaacgcaagagcgttgagagagtttaaaaaaccatccgtttctttttctatttgctttcacattgttcgtactttgttccttttttcctaatccttttaataatagaattctttaaaaagaatcatagcataaactcaacacatatatgtcaagtccctccaaacccacttctcccttcgtggatgatattgagcatgaatcgggatcagcatctaatggtctgtcgtccatgtcaccatttgacgatagttttcaatttgaaaaacccagtagtgcgcatggaaatattgaagtagcgaaaaccggcggttctgttttgaagcgacaatctaagccaatgaaagatattagcacacccgatctctcaaaagttacttttgatggaatcgatgattatagtaacgataatgatattaatgatgatgatgaactcaatggtaaaaaaaccgagatacatgaacacgaaaatgaggtggatgatgacctccattcgttccaggcaacacctatgcctaatactggaggctttgaggatgttgagttggataacaatgaaggtagcaacaatgattcccaggcagatcataagttgaaaagagtacgttttggtacaagaagaaataagtcaggtaggatagatataaataggtcaaaaacattgaaatgggccaagaagaacttccacaatgctattgatgaattcagtacaaaagaagacagtctcgaaaattcagccttgcaaaataggtctgatgagttgagaacagtttactataatttacccttgccggaggacatgcttgacgaggacggcttaccgttggcagtttacccgcgtaataaaatcaggactacgaagtatactccattaacattttttcccaagaacattcttttccaatttcataattttgccaatatttactttttaatactgttgattctaggtgcttttcaaatatttggtgtgacaaatccaggttttgcatccgttcccctaattgtcatcgtaattatcactgctattaaggatggtatcgaagattccagaaggactgtattggatttagaagttaataatacaagaacacatatcttaagcggggtgaagaatgaaaatgttgctgttgataacgtttccttatggaggcgtttcaagaaagcgaatacaagggcattgattaaaatttttgagtatttttcagaaaacctcactgctgctggtagagaaaagaagttacagaaaaaaagggaagaattacgaaggaagaggaactcgagaagctttgggccacgtgggtctctggattcaattggtagttacagaatgtctgccgactttggtcgtccctctttggattatgagaacctgaatcaaacaatgtcacaggctaacaggtataacgatggtgaaaatttagttgatcgaacgctacagccaaaccctgaatgtaggtttgccaaggattactggaaaaatgttaaagttggtgatattgttcgtgttcacaataacgatgaaattcctgctgatatgatcttattatcgacatcagatgttgatggcgcttgttatgtggaaaccaaaaatttggatggtgaaacaaatctaaaggtccgtcaatcattaaaatgtagcaagattattaagagttcaagggatattaccaggacgaagttttgggttgaaagtgaaggcccacatgccaacttgtattcttatcaaggtaatttcaaatggcaagatacacaaaatggaaacatcagaaatgagcctgtaaatatcaataacttattattgagaggttgtaccttgagaaacactaagtgggccatgggtatggttatttttactggtgacgataccaagattatgataaacgctggtgtcactccaaccaaaaaatccagaatttcaagagagttgaatttttctgtgattttgaattttgtactattgtttatcctatgtttcactgctggtattgttaacggtgtttattataaacagaaacctcgatcgagagattattttgaatttggtaccattggaggttctgcctcaactaacggttttgtttctttttgggtggcggttattctttatcagtcattggttccgatctctttatatatttctgtggaaattattaagacagcacaggctattttcatttacactgatgttttgttgtataatgccaagctagactatccatgtacaccaaagtcgtggaacatctccgatgatttgggtcaaattgagtatattttttcagataaaacaggcaccttgacacaaaatgtgatggaattcaaaaaatgtactattaacggtgtgtcttatggacgtgcctatacggaggcactagcaggcctgaggaagagacaaggtgttgatgtcgaatcggaaggtcgtcgcgaaaaggaagagatagcaaaagatagggaaacaatgatcgacgaattaagatcaatgagtgataatacacagttttgtccggaggatttaacttttgtatctaaggaaattgtggaagacttgaaaggatccagtggcgaccatcaacaaaagtgctgtgaacactttttgctggcgctcgcattatgtcattctgtccttgtggagccaaataaagatgatcctaaaaaactggacatcaaggctcaatcacctgatgagtctgccttagtttccaccgccagacaattagggtacagtttcgttggtagttcaaaaagtggattgatagtagagatccagggtgttcaaaaggagttccaagttctgaacgtacttgaattcaattcgtcgagaaaaaggatgagttgcattatcaagatccctggctctacaccaaaggatgaacctaaagcactgttaatatgtaaaggtgcggattccgttatctattcaagattagatcgcactcaaaacgacgctactttgttggaaaagacggccctccatttggaagaatatgccacagaaggtttaagaacattatgtttggctcaaagagagctcacgtggtccgagtatgaacgttgggttaagacttatgatgtggccgctgcatccgttactaatagggaggaagagttggacaaagttactgacgttattgaacgtgagcttattttgcttggtggtacggccattgaggatcgtttacaagatggtgttcctgattcgattgccctcttggccgaggccggtattaagttatgggtcctaacgggtgataaagtggaaactgccattaacattggtttttcctgcaatgttttgaacaatgatatggaattattggttgtgaaggcttccggcgaagatgtagaagaatttggtagtgaccctattcaagtggttaacaatttggtgacaaaatacttaagggaaaaatttggcatgagtggatccgaggaggagttaaaagaagctaaaagagagcatggtttgccacagggaaattttgctgtcattatcgatggcgatgcgctaaaagttgctttgaatggtgaagaaatgagacgcaagttcttgctactgtgtaagaattgtaaagctgttttgtgttgcagagtttctccagcacaaaaggctgcagtggtcaagttggtaaaaaagaccttagacgttatgaccttggccattggtgatggttcgaatgatgtagccatgattcaatcggcggacgttggtgttggtatcgcgggtgaagaaggcagacaagctgtcatgtgttctgattatgccatcgggcagttcagatatgtgacaagactggtattggtgcatggtaaatggtgttataagagactggcagagatgatcccacagtttttctacaagaacgttatttttacgctatccctgttctggtatggtatttacaataatttcgatgggtcgtatttgtttgagtatacgtacttgacattctacaatcttgcattcacatccgtacctgttattttactagcagtactcgaccaagatgtttccgacaccgtttcgatgctggtgccacagttgtaccgtgtgggtatcctaagaaaagaatggaaccaaaccaaatttctttggtacatgttggatggtgtataccaatctgtgatatgcttctttttcccctatttggcgtaccataaaaacatggttgtaactgaaaatggccttggactagaccaccgttactttgtcggtgtcttcgttacagcaattgcagtcacttcatgtaacttttacgtcttcatggaacagtatagatgggactggttctgtggcctattcatatgtctatcactggccgtgttttacggctggacgggtatatggacaagctcgtcgtcaagtaacgaattttacaagggtgcggcgcgtgtattcgcacaacctgcctattgggcagtacttttcgttggcgtgctgttctgcctactgccaagattcaccattgactgtatcagaaagatattctatccgaaagatatagagatcgttagagaaatgtggttacgcggtgattttgacctctacccacaaggctacgaccctacggaccctagcaggcccagaataaacgaaatacgtccccttacagatttcaaagagcccatttcactggacactcattttgatggtgtcagccactcacaagagaccatagtcacagaggaaataccaatgagtatactcaatggtgagcaaggctcgcgcaaggggtaccgtgtctctaccactctggaacgccgtgaccagctcagccccgttacaacaacgaacaacttgcctagaagatcaatggccagtgcccgcggaaataagctcagaacttcgctggatcgcacaagagaagagatgcttgccaaccaccaactggacacaagatactccgtggaaagagcacgtgcctcgctggatctgccgggtatcaatcatgcagagacgctgctcagccagcgcagcagggaccgttaatgattacaatttttttcttcctttgtactatgtataccaatgtgatatgatatagatttcatataggatgtgatgatgtgtatcacccggcacggctctaccccgccctgtggggtgtggagaaaacgccgcgcagagccttgagtaggaaggggctgggttctccccttcctgccggggtccgcccggcgccaagagtaagagagcgaagccggagacgtaatatgaaaaaaattttgaggggaaagggcgtccgcaagggcaagggcaaggggaaggggtggcgttttgtgcttcaaggaattatatttcgttgttttccgcactatggcggcattgtggcaagtaactactttacggagaaagactagaaaatggttacaactgccactattaccgcttcgcattctcttgtcttacaggtcccttgaattggcatttacgtttacatccgatccggtttttcaccaaagagaaaggaaaggaaaggtaaaaatagcaaaccgaaaaagaaaacagtattttctctctgtttaggattattaccactacttactgaagagaagtttttaacgtttatcgtttgtgttgaggtagaagtacaaacgcgtgtgtgagttgtgtatttgaaattattatccttctacgcatatcgggaaaaagttaacggaaaaaacaagaagaaaacctcccccctcctcctcccgccatacagaaggcaaaagaagttggtctgttaggaagaaaatagccaagtaataatacgtttggccagttgtattttttttttgtttcgctaagtctcttgcttacagaaactctttgcccaccacatatttcatcgtttttcctttctgttcatcattaacctccatttcccaattttttccaattttcaatttttttcactatttgtttctttgttgggcgtttaaaaagtatttgcttctacaaagtgaacaacatcgttgtaattttttttttttaatttgaagaatagctacaaaaacagactacaatggaaatcaagccagttgaggttattgatggcgttccggtttttaagccgtctatgatggagtttgcaaatttccaatatttcattgatgaaattactaaattcggaatagaaaatggtattgtcaaagtcattcctcccaaagaatggctggagcttttagaaggctcacctcctgcggaaagtttaaagactatacaactagactccccgattcaacaacaagccaagcgatgggacaaacatgaaaacggtgtatttagcatcgaaaacgagtatgacaataagtcgtacaatttaacacagtggaagaacttggccgaaagtctagactctcgaataagtcaaggtgattttaatgataaaactttaaaggaaaattgccgcgtagatagtcagcaggattgttatgatttggcacagttacaaattttagaaagtgatttttggaaaaccatcgctttttcgaaacctttttatgcagtggacgaaaactcttcaattttcccctatgatttaactttatggaatttgaataatttgccagattctataaactcaagtaacagacggttacttactggtcagtctaaatgcatttttccatggcatttggacgaacagaataaatgctctataaactacttgcatttcggtgctcccaaacaatggtattccataccgtccgcaaacacagaccaatttttgaaaattttatcaaaggaaccatcaagtaataaggaaaattgtccagcttttattagacatcaaaacatcataacttctcccgatttcttgcgaaaaaataatataaaatttaatagagtggtgcagttccaacatgaattcatcattactttcccttattgcatgtactccggattcaattatggttacaattttggcgaatctattgagttcatattagatcagcaagctgtcgttagaaagcaacctttaaaatgcggctgtggaaacaagaaggaagagcgaaaatctggtccgttttcaaatttatcttatgattctaatgagtcggagcaacgaggctccattactgataatgataacgatttatttcaaaaagttcgaagttttgatgaattactaaaccattcctctcaagagttacaaaatttagaagacaataagaaccccttgttctccaatattaatatgaacagaccgcaaagtagttctcttcggtctactacccctaatggtgtaaaccagttcctgaacatgaatcaaactaccataagcagaatttcttccccgttgttatcaaggatgatggacttatcaaatattgtggaacccactttggatgatccgggttccaagttcaaaaggaaagttttaactccgcaattaccgcagatgaatattccgtctaattctagtaattttggcaccccttctctaactaatacaaactccttactatctaatataacggctacatcaaccaacccatcgacaactacaaatggcagccaaaaccacaataatgttaacgccaatggcattaacacctctgcagccgcatctatcaataataacattagcagtaccaataatagcgctaataatagtagtagtaataataacgtttccactgtgccttcttcaatgatgcattcgtccactttaaatgggacttcaggtctaggcggcgataacgatgacaatatgttagctttaagtttagcgacactggctaacagcgctactgcgtcaccaagattgacgttaccgccgctgtcgtcaccaatgaatccgaacggccacacctcatataatggcaatatgatgaacaacaacagtggtaatggtagcaacggtagcaacagctattctaacggtgtgactacggctgctgccacaactacatcagcgcctcacaatctatccatagtgtcccctaatccaacatacagtccgaatcccctatctctttatttgaccaactccaaaaatccattaaattcaggtcttgcacccttatcaccttcaacatctaacatcccatttctcaagaggaataatgtggttacattaaatatttcaagagaagcttcaaagagccctatatcttcttttgtaaatgactatagatctccgttgggtgtaagcaatccactcatgtattcttccacaatcaacgattattcaaacggtactggaattcgccaaaatagtaataatattaatcccttagatgcaggtccatctttttctcctctccacaaaaaacccaaaatactcaacggtaatgataatagcaatctggacagtaataattttgattacagtttcacgggtaacaagcaagaatctaatccatcaatcttgaacaataatactaataataatgataactatcgtacatcttcaatgaacaataacggcaacaattatcaagcgcattcttctaagttcggtgaaaatgaggtcattatgtcagatcatggtaagatttacatttgtcgggaatgtaatagacagttttcctctggtcaccatctaacaagacataaaaagtcagttcattccggtgagaaaccccattcttgcccaagatgcggtaaaagattcaagagaagagaccatgttctgcaacatttaaataaaaaaattccatgcactcaagaaatggaaaatactaaattagctgaatcataggtcaagaaaatgatatacaaaatgggttcaaaaaaaatttttatcgaatattttcctgtaataatattgtttcttttagaaaaattttggttttctataatatatttattctccatgttttaattttctcagctattaatgttcaacttattccttataaatttgtcattcatttttcatatatatcgttaatatataatctttgcctgttctgaatcctttttcaacgaccaaaactttaaaaaaaataagtaaaaatcttacatacatcgtaaatgaaaatacttaggattgtaaatcatcaattatactaaatagacttttcaaaacgttcctttttatgttccaatcatagttcaagaccccttcaccagaacctaattttgtattcttcagtccatctccgtacgcaattcgaacgaaatcactttgtaagccacctggcacagagacaacttcaccattcaaattatttgcagctaaatcacgttctttgactagcctagaagtatgttctaaattatcagcggcaatctgcgcgttatcaataatttcctttgaaatgccacacattgacgcaacatgcataccaaaagagccttcactttgtccttcaagcatcttatacaaaaatgtaacgttcctagtcgcttcatcgactagaatgctcattttcagtggtcttacttgaggatggtgcttgaaacttgatgccaatgtcccataatgtgtggcaaaaaaacccagactttgaatatgtgtcgcgacatgatgtagcacactttctgcaattgcaaaaccatcactcgatgaacctcctcttcccaactcgtcaacaactaataatgacctattggtagccatgtctaatattttttttgtttccgccaattccacaaaaaaagtagatttaccttgcatgatattatcattagcgcctaaacgagtcatgattctatcaatcggcgtcagaacggcagattcacaaggaacataacatcccatttgtgccataattacggcaatacatgccatcctcaatatcgtggatttaccagctgcgttggcacccgttaacaatcctaatctgggctgttctttacctaattcaatgtcgttaggaatgaagtcctttgctgtagtagcgccgaggttaaagcatggatgtcttaatgatttaaatttcagaaaaccatttaattgagtattcgttttcgagtccacctcatctacaatggttggcctacaagagggagcacctagatattcagatgtccttgtaattgccaacaaacaatctatgttagagatggcctgtatggttggcatccaaattgtattataatgcgcatcaaatttttgacataatctattttttaggtcctcctctaacgtcttgtgtatttctttagcctccgccatcgatcttgctaaagctcttacttcatcagagtagtatctcttgtacgttttgttcgcagccatttgaacccaatttgatgggacatttttagttgcagagataggaatttcaatagtgtatatctcctttccggaatctttatattgtatattggaacatttgaattgcttcctataagtcatcagaatttccatcaattcgtcttctagctcctgtattctatccattgacttatcaaactctatgtcaaatcccctttgtggtacaatgatattttcattgattgctttttgtctttcaaaagcattagtccagcttttgacagcttccacaagtccctcagggaaagaggatatgtattttgaaacatctcccttcaaatcgttgttctttaaagagtcttgtaattcaataatcgtttcaaaagcggtaattaccttttcaaaatctttcactttaattgtcctactatggatacgggccaacattctttccaaatctggcaattttgaaaatgttatctctagctgttctcttaatgtaatatcttgtaacaaagagtcaacactatcgagcctgctttcaatatcattcttacgtaataatggatgcattaaccactttttcatcattctcttacccattggagtaatagccctgttgaataatttgaacaaagtacccttatcagaaccatcaaacgaattggaaaatatttccaagttctgtaaagtgataccatctaaaaccatggagtgttgcgattttacaaaatcgtactctttgatatttttcatcgaaattaaattcttatccagttttaaccacttcaaataatacaataatccaccaaatgcactaaagccaacttttttacccgtatcataataggatttcaaaacctctggccaatcttcttccgtagaaaagtattctgatgatatgatttcagcataggttttatcgcagtcataaaattcttcaccggctttaacctcattaaaaattgcattgggtgctgaattgaattttacaattttgttagctagtgtgcttaagttattcctctccatgacgacttccataggtcttacttgcgacattaatgtgtccaatttggtgcattcactatcatcttcaaactccagcatttgaagctcaccagttgcagtatcaatgaatgctgcaccgaatatttttgtattcagcttttgcactatcgttgatgaatctagctgagtttcattgtagaagttaccaggttcttccctgatggcaagacaaaaagtagccagatccgaatgcaacatatctccatcagttaacgtacccgatgtcaatatgcactggagttctcttttaacgatacctttagaaccttccctcatttctttagccaacattgactctctttgatccactttcgcaactttatatcccatttggataaactgagcggcccaatattcaaatgacatctctggaatcccagctagttgcatattagcgcgtcctccacctgcaatctttaagtcaaataatgcattagccaataatgcatccttttcatataattcaaagaacttaccctttttgaaaaagacaatacaatcccacattttggatttaatttcccaatattgtttttcaaacggagtaaacttgttccatgcagaagatgggatgtacagtgttcttggatcgtactctggatcactcttgggacggcgctgagcatctcgttcatccactaaccattgatatcgttcttcattttgtttattgaatttgctagacttagaagtcgctgatggttgactatgagaaggattgtacgatctacttggtgcctgatttggcctgcttttcttttttgagttgtcacgggatatatttcttgtaaagggcgatgaagaatgcgaagtgttgtatgaaaattttttcttagaagtcgtttctgccagagagattaaatcatcgtcatcaccactatcttctgccaattctcctttgatgtcctctttgtcgtctgcaatatcgtcatcttcatcgccgtcatttttatctggtaaatattcatcctcatcgctttcactatcaactaccttacccttcttccgtttagcagtgaatgtagtatctgagtcatcatcatcactttcggcataattcactctccttttgtgattccttcgagattgggaagatgataaatcctcgtccgtagtggtacttttaggttctgtcgtgttactatttaacatagtatcagattggggctcttgagaatgcattatgtcactccttacagttgataccgtttcttcagctattgtcaaatcattgtcttcgtctacatctacgaaaagtttgcctgtctttcctccttgtggattctttgttatcttatcagtagctgtattttctaaagtcgctggagtaggcttctggaccttctttgacggtgtgccagaaggtacctgttttgagaaaaaagataacaaactcgattgcttcattttcttttgagaagatgtggagccattttcgaagtgtgcagtcttagaagttttaggggtagctggggccattttggagttcaaattggctttgtcaaaattaactagttgctccaattaaaaaatcttatctgttagcaaagaaggctccaaggaaaagctcttattagtttcaacagatgtaatttcaaatattttctctatatggcgatgacctatacatgaatttatgaaaaagtgagacgcgtatcagctactgctcacgcgtttattttctccgggcaatggttgttcaaaaagccaaacttaaccagaagccattcattatgtcacacatataaaaatgcttgcataccattagttggaaatggagacttttctgtttcaatttacactaaatacatctatttatttaagattggagagcatgctgcaaaaaatcagggtcttcctccaaggattccttgataatgtctaaaccgccttgaaactccccatttatataaagttgagggaaagttggccattcagaaaactttttcaagttttgtctaacagattcgtctcttaatatatcaaagaagccaaatcttacttgatgttctctcaagatacccacaagttgtctcgaaaacccgcatttaggttcagaggggctccccttcataaataacattaccggcgcggcattgaccaatttagtcaatctagcgtttatttgctcctcagtttcttcttcctcttcttcgtcgtcatcgtcttcatcattatgactcccctcatttacgtttgcattttccatagtatgagtttgtgatgatccggaattgactgagttcttgcagtcttctaataaagacacatactcctttggatccgcgccggataattcttttaagattgtccctttgtgaattatgataaaatatggaacagctgagatttcaaaaagttctgaaatttccgagttttcgtccgcatcaatggataagaaagagacgttggaattggaaggctcattactaatggcctcaaaaacctgctttaatgctttgcatggttctgcccaactggtatggaaataaagcacgattaacttgtcgccggccgcagtggtagttaggtaagtaaattgctcttgatcgttaatttcaataacaggcatttcctgaaaaagttttgctgctgtgtaatatcttgcttggtggcgtttataacagtacgaggtgtagttaaaagaaaatgcagatggaacctgaaaagaacacatttagtctttgaaatatattttaatgacctcttagtttggcatctcatgacccggcacacattctctgaaaaaaaaaaaaagtaactgatggttcaacagagaagccacagttaaaaaaggtcctacccggattcgaaccggggttgtccggatcaaaaccgaaagtgataaccactacactataggaccgtaacaactgtgtattgttgtattacgggctcgagtaataccgcagtgtcttgacaatcctaatataaacagtcttagggaagtaaccagttgtcaaaacagtttatcagattaattcacggaatgtcacttatcttatatattatataaaatatgaatcatactaagtggtggaagcgcggaatctcggatctaaactaattgttcaagcatttatacgtttgggtagttcagctagggaaggccgtgttttatctcatgttgttcgttttgttattgagatatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgtttgttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtgagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgcactttctctttgtattcatcttcatctatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatttcgttatcaccttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcctgttgaagataaacattgaatttattactcttttagggtctatttcttttctgtcataatatttgtcagtgtcccaagtattcattttcaatagttggttgacttctttgtggtatgcttcgatatatttttccttttctttaatatctttattataggtgattgcctcatcgtatcttaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactatttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgccaggattagatgatgctgagtgtatgtggtgagcagatcttataagggttcgtgatgctcctgaatcgagaaggaggtgtccagggagttcatcatcagaatgattagtgtgatttaccgtagattcagtaagttcctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacagttataaggttgtttcatatgtgttttatgaacgtttaggatgacgtattgtcatactgacatatctcattttgagatacaacatgtattttgtgtttaacaaactgtattatctgaaaactatatgaacagatcttgaagtaagcttgccccccctattccagtgtattcaaaatcacagtacgttttcctaaaataccatcattcatatttgctggtttatgttactacattggactgtatatccatgtgggaaatgcccaatgtactgataattgttgggattccactgttggtaaacgcaataatattaggtatacagaatatactagaggtttttcttcgaggatcttgggatccaaaatagggaatcggtatttctgcataatattgctattatttctccttctattttacatgcttcattatcctattacattatctagctatgcaattcagctctcattaagtctaatgactgtttttcaattgttgtataatcttcttatacctcatttgataatatagcaataatataaaatagtactctataggttataggagtcttaatacaatgagcgcgccattatcgttctgtaaagtaaatagtcattcacataacgagctaataaaaatctccagatggcacacatagtgtatggcaacatcaatgagaagaataaggtcttcgaggaataaattgttctaatcatgacaaaaactacataacagaagactgaaagactgcattaaaaaaatattattagcatgaacactagtcaaaaaatgacactaagatttcattccaacactacattttttcggaaaacgttttattgaagtactgctttatggtcagcacgtatcgcttcatatatgataaccttacacagtatctttccgaaaaatcatgaaacgaagtaacacagcatcaatttctgtgagaaatagacaaagatgtttcaaaagttccaacatatagtgagcatcgttcatatacctcgtacaaatcaaatttgtctcttggaataccgaaaattagccgctcaaacactctccgttgttaatgacaattacaccatagccgctgccgtagaaaatgcacggtcttccgtgacgagaagattcgggggcgaatcgcatagatcgctctttctcctctttctcaattctgtcttatctgtatttataacatgagctcataaacaaagtccctgtttatatatattgatgacttatatatctttcgcttcagcttcttccctcatttctacttaatattatcttttgaaattagcgcgatcaattgcattcttttccacaccaccttcaaatttaagaattcatatttgaatcgaaccgtatgttttacctctcaataacttgtttcattaatagctccttccacaaccaccttcatcttctctgatttgaattattaccgacatgaatgttactctcctgaaaatgttaattatatcaacttaacaggccttgaaagtgaagtgttatagtttctcttcctttgtttttcccactttcttttttttatatatatcttatattggtttaagcacagcggattgctttcttctaatacaagaactagaacataggtccacccgtgtgatgttgcattctgaaatgtttagttatctctgtcagaacagcgaggtaacacttatttttgttacgaccaatccgtaattcaagcgtgggtattcatatgaccagagataataatacagcgaatactattgaaatcgtcccttttttgtttaggaagaacggacaaatcggtcgtctgctcgaaatgattagtagtgtgtcacccggatcagcaaaatgacacacacgaaatacgaggaaaaagtcggtcgaaaggggcaaatgttattataagtccctccagtagtcttttttttttcaaatattcatcatcaaaggttacgaaatcttttgagctatcttaaacattcgttctttttatcaaatttcaattactaacttattttttcaaaaaaaattgcctctcccggtttttaatcattatttttttcgattgattaagggggaaaagcaaagaacgagaaaacttggacagaaggttaatactctgacaatttcaaaacgaagtaaaaagaaaaattatcaaatcaacaaaaagtacccgttacaacaaaaaaaatgtcccaaactcgtgaagattctgtttacctagctaaattagctgaacaagccgaacgttatgaagaaatggtcgaaaacatgaaggccgttgcttcatcaggtcaagagttatctgtcgaagaacggaatctattgtcggttgcttacaagaacgtcatcggtgctcgccgtgcttcatggagaatagtttcttcgatcgaacaaaaagaagaatcaaaggagaaatctgaacatcaagttgaattaatccgttcttaccgttctaaaattgaaactgaattgaccaaaatctctgacgacattttatctgtgttagattctcatttaatcccttctgctactactggtgagtctaaagtattttactataagatgaagggtgactaccaccgttatttagctgaattttccagcggagatgcaagagaaaaggcaaccaactcctctttggaggcttataaaaccgcttccgaaatcgccacaactgaattgcctccaactcacccaattcgtttaggtctagctttgaatttctccgtcttctattacgaaattcaaaactctcctgataaggcttgccacttggccaaacaagcctttgatgatgctattgctgagttagatactttatctgaagaatcatacaaggatagcactttgatcatgcaattattaagggacaacttgaccttatggacctctgatatttctgaatctggtcaagaagatcaacaacaacaacaacaacagcaacagcaacagcaacaacagcaacaacaagctccagctgaacaaactcaaggtgaaccaaccaaataagagcgctgagaaatacaaggggaaatgaagatttaccactccagttttcttgctaacgaaaatgaatgcaattcgattttgatactttttttaggggaagagataatatcttcgtctaatacaaattcacaaaattttcaattttaccaactacaaaatatacaaacctctaaaaaaatagtttcttaatatataacataaaatagtttttctgttactattacttctatcactgttttcttcgtgtattcttatattttggctatcgttcagagttgagacaatttgcgagagtaattgagtagtaattttcgtatgttttaaaataagttccttccattgtatacgcacctctttcttctgttttcctttgaatcttgatctaccttacctattgaaggtgaaggcatcttttctcatttgatgaaacagcgctccctgggtgtaggggggcgggggtatagtagcgtaaatccgcaacggaaaaatacttcgagtggaaaactatgaccattaatatgtatgtcttacaagagaggacaataaacaaagtcaaataaccacaagggatcacaaacgaaaggatgtcagttattcctccaaaattcttcaagattgcaaatatatcaattggctgcatagacattattgctgccctttcacaattgacgtatattttcaccaatttaaacgtcttcctcttggcagtttacggactggcactctccgtacctatcgtctatctggagttcaaggttccgtcaaatctttacaggtatgcttccttttactttagttttcttggaaggggtttatcttatattttactaagtctgataatcagcttcggcggtatctacaacatattggcgggaatgtttacttttattttaggggttgcctttattgtttttcatttttcccagtttgtggaagaacctgctaacttcagagcacccggctcatctttgtcaattggtgatgatgacatcgacgatgacgatgacatgatttaatattagaagcccatgtctctcaatccgccggtgttacaaaagcatggcgaaacaggcgtgagatatttaatcttccatctcatctgtatagcaaataaaatgtaattataatgcaagattctgagcaaatgaaccaagcggttttagtacagctaggttgactttttttataatattctattttacattttatgatatacttatattatttatatactagctttagaaatgatgaagtttcctacattttcatggtttcttcaactccgccatttgatgtctcaacactcttctgcttcattggctgcgtttcctttaataatagaccgaacctcttatccttggccaaagtagctaattgaaagatcccttgaacaattgaatcttgtggatttaattcgtgctgagagtgaatccagctcggttgacaggtcttagaaccaccagttaatctcaataattcgggtctgtccgttgtacttacactagagtcacataatacgatggtattacattcacgagcaactggtaaagaaatcgattccttggttgaattcattaaggatttaagcttgatggctgaaacacccaattttggtaaaggtaactcatgcccaggtaatgttaatgtagaggttgcatcataacttaaattaccgtttggattggtagcctttaaaatatggtcccatggaacccatctagcaatttgtattggactttccacacataagtagttgttggaaatctcactcatcccaagtctaaatgatttcaaatctttctttaagctttggagttcttcttcattttcgtgaacgaaaggaaagttagaagataaatgagataacttgaatggataaacgccttgtttatcgattttagttaataattgtctagaagtttttaatttaagaatatgggtttgagcaaaatctctaacatatgcaccgggtcttgcaatcaattctccagccttatgagatttacctgtgtaagagtcaacggtttctaaagttactaaaccctttttggtacaatgctccaaagatgccattttcaaatcaattaaatacacttcacctgattgaacaacgaaatcatcacttggaatagcagaaacattagtgaatggagtcgattgtccacgatctaccactgttaaatccttggcatcagtattagatagcaaatctgcttcttgatgggactctgtccaaacaacacccttatattccctttcggcaacaataccttcgttttggcctgccaggaatcttctaatccttcttacacgagaaccaggaacaacgccacagttataagatctggcaatagtatccactatagttctaatcaattggcctgtgataccacttgaagttcctcccagtgaggcaggaagcttttctggagtcagagcacaggctaataaagcaacaactgtttccatagcaatgtgagcagcagctacagcatccgctttaccacctagtagtggcccagtgggttgaagaataggtttggtttcatcaacggggtaaataaccatagtatgagaaacttcagaggtgtaaccatcaatatgaacacctagtgtaatcttgactaaatcccccggtctcaaagtcccagtgacagatgatgcaaaagtggagtctttccccttattccagtttaacaaattttgagtatcatctatttcggggcaccatccaccagaaatttggtcgatatcaatagtggttggaatggcaatacctctttcattaactttgtttttataatattgttccaaccgggtcaaaataaaagaatcggtaagcaaacatagctctggcacggttaattggcgctgtgtggtcttagagtgatatgaatcattgatcaaagaagtaacatatttcaaagcagtttgtgcgatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagcaaaaaaagcttcacagaggcatgaccctctccgggtaaaaaaaagcttagggttaccggcctgtcatttttagggcattatcaattttttgccatctagttgcaactataataatacagtatgaattgcacgaaagagcagtcaatgtaaattcacgaagtgactgacagaatactgacatcagctgatttctcatagagctgtttctctgataacacgttgtttgaacatcgacaagatgaaaatctagaagtatcaagtttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttcccttcttttcttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaactcccaaccaaataatagagctagagaagcccagtactctatccccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaacctaatgaatacaccttctacggtttccactgattatttgccacaacaccctcacagaacatcgtctttgccaagacctaattccaatctctttcacgcaagtaatagtaacctatcccgagcaaatgagcccccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttgggttatcctatacacctgttgaaagacaaacgatatattctcaagctccaagtctaaacccaaatctcatattggctgcaccccccaaggaaagaaaccaaattccacaaaaaaaatcaaactatacatttttacattcacccctggggcacagaagaattccgtccggagcaaactctatcttagcagacacctctgtagcgttgtcagctaatgattctatttctgctgtttccaattcggtaagagcaaaggatgacgaaaccaaaacaacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaattagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatcaggtatattgaatcaggattttgtattcaatgaggacaatatcacttcgaccctgcctattcttcccattataaagaacttttcaaaagatgttggtaatggtaggcacgagacgagtacctttctaggtttaatcaatcctaacaaagttgttgaagttggaaatgtgcacgataatgatactgtaatcataaggaggggattcaccttaaattcaggagaatgttctaggcagagtactgtcgacagtatacaatctgttctaaccacgataagctcaattctttcccttaaacgagaaaaacctgataatttggcaataatcttacagatcgattttacgaaattgaaggaagaagacagtttaattgttgtttataacagtctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggttgaaaaatactctatatcccgaaaatattcatgaacatttgggtattgttgctgtatcaaatagtaatatggaagcaaaaaaatccatactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaacatgatgacgatgacgaagaggataatgatgattcgaccgataatgaacttgataatagttcaggatcactgtcggatgctgaatctacaactactattcatattgattctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggaaggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaagaaagcatcccgccaaacgtttcgtaactacatattgttacatagtttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagagttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttctatatttattacggaccgtgaaacatcatcaatctcgtagtttctatgccaaaagatttcactagcttccttgtaaaccccatattttattttgtctgcttcgtaatcagtccttgttccttgatatatatctttcacctcagttaggtcaatcacattgtccgtttttagtatttgatcaatccttctatgaaaacaatggaaagcatagaaatctctggaatcatattcactttgggtcgtttgacagttcatccactcgatgtgatcatttgtgtctaagggataaggttgttgctcgtaaacctctggaattttcttccactgtttccaaatttcttctttttctatttctgtgctagtgtcgtcaatcatcgaatctataggcaatggtgggtttgctctatatgctttcatcgaaaaaagcaaattctcacacgtgaagaagtaagctgttgaaatactatatttaccaaaatttgtcctcgcagagccatacttgtcagtcaatcttattaaaaaaccttcaataggtgttggttctttcagacattttccttctaaagattttgtttcccttaaacgattcgcaattggcctgtactggattaggtgagattgacaaaatgcaaaaattccagttaccagagaatcttcatcacatggaatccactccaatctatcatatcttttcagggcacatcctagtacaggattttctgtatcccattttctaatcagatagtcataatgcgccaattttaatttctccaaaatagcaactgtgaaatatcgtaaaatgggatgctggaaaattttataacctctttgaagaaaacatatttttaatctatctttttcctgcttccctaaatctattagcttttggaatataatttcattcaagtttatttttatcgagatctcagttaatggaattttcaagttgatggcaggtgtaaatagttgtcggtccaaagattctagtagaaatttgtaccatctaccagacgaacgaatactgctgcatcttaagataaaaattttaatgggggaatagtgttttaattcgtccttcttttcaatactctcgtctataaacccacctaaccgcttatcaggcttttgtatggatatagttttgtctagagagctgtagaattttacaatacaatttcttgaaagaaaaaaatccaacgggttgcggtgatactttgtagctatggaactgatatcttcgatttctgggatatgacgatgacgatagaactgtaaaagtatcgggggatcgaatcttcccgtggatcttgcaataacaatatattctttccaccgttcactgacccttgtatcaaagcactcgttttcagagaagttgggaagtggtactttattttgtatagcttcttttaccatcactagcattttttcttttttaaggatctgaccggtgcgtttcttgacagttgctttatttgttagtgaatttgtcatacctaagaaagttccaacactatctttgattttgcagctagttttgtttcgagcattgtgaacatgttttcttatatgatgagaatgtttagaggctagcctatcgtgtataattctctcttcctccgtcagttcggtaggccatggaggtaggatattaataaacggaagatgactcgaatgcaacttaccaatgtccacgcatgaacctctttctcttttttgaaaggcatccgcacttttacgtctttcatcgagataagtcccatatttctgggatgttttccacagcatcaagttttccttttccatactttgtagagcattaaaaaaaatcttttcatttgcatttaatcccacgttattgatagtattagatgttgaaaagccatcacttaggtcattcgagttaacaaattgtcctgatctacttagaatactatttggggcggggcttgtccgatttgttacttcaattatactgtcgggatatctcaaagtatcttcagaaggttctctattataattaaagtctgtttctccaacacttctggctgaagaggggctcggtattctatcaaaatgcgaataatcttttctggatatgctttttgattcccctagatcttttcgtttcaaattcgaaaggagtgatttattccttttatttgtattttcttgatcttcttcatgtaaaactgggtggatatccacggcttgcgccgtatcgatgagaggcaaactattgtttctagaaagctctgattttttttctttcaaaagctcttgtcgcatgaagttttgatcggaagaactcctacaccttctgggtagacttaatttatattcacttttctgcacaggacttgacctagttctcttcatctccatttccgcttctttaagacgatgaccgttgtgaattgatgtattatcttcataggaccatgtaaagtgctttcttaagtacaatgcagttgggatcttccctacacgctttttgtaaattgttccatagccatatcttcttagcatgtcagattgcttcctaaccttccgaagtgaaattttagttagaagtttccagacttgattattttgatcagcgtaccattgttttggaataccacctagcaaagtcacctgtgaacatgctgaaagctctgtaggtgaaacatacgacagtctaaacgctgtgaaggaatgccggggaatggtgaagaccttgacatttgcattttgtggtgagctgaagctagtcactctctgcgcgtacttaacatcgtcttcaacaacattaacgatagaatccatatttcgaaatgtttcgaagacaaatccctttcttttacaatcactgtatgctgacttttgttattgatattttcaccagacatttctttagccacaatgattttgttttaccatatctttgaagcacggcgcaaactccgaatatcgcataaagaaggttgagagaatgttttctacctttaaaagaagaaaagagatccttcgaaaacggtcgatcgataataactgtaattggcatttcaaataaatagaggatagttaaaataatcctcgagaagcgatatctcaattagataattaagatccatttttttttgagggaggtttactcatcttcttgaaactagtgcatgagtatagtaaaattagtgtttctactgggggctacttaaaaaaaagttacatacattataagaaaatctttttgtgttagtctatttaatagtaattctcgtaatcaaatctatcgggcataatcgctggggctaccactgtccaaccgtaaagggcataacatatccatgcactaactatttttacccaagaataaaaatatgttcttcctacgggtataaaatcacctacatcatcctgggtaacgtttattgttagtaaaattgcaatccactgggttgccagaaagaatataacgtggaacagagtgtaattgtacttggttccagtcctttcatcatcattttggttatccattgcgcctgtaggagatgatgtccctaaccaagcggtatcatataaggcactttccggtaaagatccttcttctacagcttgtttaatagcttcatacctcaactgatttcttgtctgtccacctagtccttcgtactcgatatcattcccgagatatatagcaccattagtattggtgccttgaaaagcactattagcagcggctctagttgtggtgtaagcaatcgcaataaaagtaaataaagagcccaaaatgatactaaacttacgggttccactagatctaaccaacggattacacattttgtcatccggttcggaagacatggcactcattgtcaaataagtacagtaaacagaaaccatactactttgggccagcccacttttagggttggcctcttggatcttaggattcaccgataagacaagcgttataacagttaatattaaattgactgttaccgctgtttgattcatgttacattgttgatgacaaaacataacatacataacaacagtcatgataatcgatgcggtatacattgaagttgtccctaaaaccaaaaatcgttgccagaatgaggaatcttcatcttctgactcaacgtgactaatacacgtttcagcccactcatgagcgaagtctactaataatataagcccaaccaggatgaaaattgctccactagggactgacacccacttggaaaagaaaatataaaagtcattggggatgacaaatgacaaaacaatgagacataaatacagtataaattttaaactccaccacgaattctgtaatgctgctcttacgtcattagtcgactttacgcccgttagtacaagcgccaatatcaaatgtaagcatcccaatgcaaaattcaacctatgaactgtaaaaaatccacattccccagtcccagtacatgtcttccctggccataggattgatttgttcgcagaataggacacccatgatatcaatgagttaagtaaaagccaaacggcgtacagaagtcttgtccctaaagaagaagatcctagggaagatgcagtcttagtcaccaagtttgagcagcaacctccaaaacaggacgccacgaatgagcccgccatgctaactggcaaagaaattacggcacccatggtagattgttgtactttgtgatgggtattttgatatgaagtaaatctgttgtttgattataaacttcgttttgggggcataaagacctcaaaaacagttctcttttttgttagaatctaattgtcggaacttctattgtagccgagagacataaacaaaagaggtacaaatactacaatattcgacactgtgaaatgataaaaaaaatctacccaggaaaccctatgaggaaatgtcgaatactattgtgatagtctatttgggagctaacagaatcgaaattggaagaagtgctgatgcgtgtccacaagaaattatcgcctggaaaacaggtagtattaatgaaaaaaatagggaagaattgaaaaaaatatttgaacattacttccaaatttgcaacatcttgggaaatcgagaagtacaagtgttgatactagaagatatcttcatttctgtagtagagaaaagaattatttgtagcatcttgtttaaggaatttgactgcgctcacgtttcgtttgtccccagggccattgtgcactgcttatcctgtaatacaaggaatgccatagttatagatataggtaccaattatactacatgcgtacctattttcgaccttagacctttgcaacagttcataaaatactcaaaacgaggcaaaagacaggttgagtcaagaattcctctcccgggcagtctctacatgccaatattttttgacgaagaatacaactctaaaaattgtgaagtagatgaaaccccggtaataaatcttgtcaaaaatattgtagagtcacttcctatcgacttgagaaggccactgagagaaaatatcattatagtaaacattgaagaggcgtatgaaacagtaataaggaatttattcaagttaaaaatggatacgtccaaaatccagtttcctaaaaattactggcaggctggttctgcatgcgcgaaaatacttctgcactataaggggagcaacattgtaggaatagaaagagatgagttttataacaatcctcatattgctcctgattggtttgattattacttcagaactggagtgaagcgcttacaataggctttatgtatatgtagaaaacaaaaacaggaagtgttctcttcaccaaactgcgtctttccacaacaattagccttattgagcttttgatgtaaaagtttatgatagtaaagagctatttttaacaatagaggagaaaaaataaaaatggtctctagcgggatcgaaccgctgatccccgcgttattagcacggtgccttaaccaactgggccaagagaccaatttggatcgaaagtgttgtatctcaaaatgagatatgtcagtatgacaatacgtcatcctaaacgttcataaaacacatatgaaacaaccttataacaaaacgaacaacatgagataaaacacggccttccctagctgaactacccaaacgtataaatgcttgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacagaaagttaaccattaatatttcacctaattacacactctcctaaagaatttggatttgataactatcatgtcatttgaaagagtaactcgttttcagatttattattgccggaataaaaataaataaatatatcgaataatattctttattattaatgtcgaatgagttgttagaagacttcataacaattatcggatttaatggaagctgaagtgcaagaattgataatttaataagataatgaatttaatataaaatataaacggagagagaataatgttgttatatagaattgttgattcccttttgcggatttcttatatcctcgaggaaaacttctaatatatatccaatataatcgtttccaaattgtgaaagaaaaaaaaatcttcaatacagtgtattagtgctacataaaaacgcgttaaaacttgcattccaatttatcaaaaagtttgccaggacatataggatataaatgcattgcgaagtaaaacacttctcaaaaaattaaaaaaaaaaaaaaaaataaaactaacgtattcacttcttttactttagtggagagaataacgaaatcactcaactttaatggcagagtatatcttcctaataaaaaacatactactaaaaaaaccaatcgctccagtgacgacacaacataatgcagatataataagtgaatatccgagatagagcacgacagtaataactccaccaagcttgaacttagtaaatagtatggagtggatgaacgtatagattgaacatcctaaaccaccaataataaaacttctccattgccatagccagttttctagacataacgagtaatatgtgatcaagatggtaactaatgaggttgtcaaggtcaacaataagaatgaaaagagtaaaaatccaaacatataaaaaattttgttgaaccataaactggagtaaatgaagtacagctcaaccgctattgatccgaaactgaaaattccagcgattaaggttgcttgtgctgttctcaagtaccagggttgatatggaatctgtctggcgatttggtttgttttagttggatgctcatcccaattacactgcttatgagcaacaattgaacccgcaaacgacaacggaacagaaactaaaaaccatagaagaatgataaagaataggcttctcgctgggatgacacctgaagaatgtgcaaataacaaaaagaagttcattattacaatcagtaaaaaaattgctccaggaagtaatattggcgttaatatcatattcgccttccaatagggtccacgaaaaaatttgtagacacccattgaggcgtaggatcctacaaatccaaataatgcataaagaacaaacattacagttggcagggatcctctggaaacaggcgacacaagacctactgcggcaaaaaaaatgctacacatgaccatcaaaaataactgcataccggatcccacaagaatggatagcagcatcgacttagatggggttctaaatacgtcaccatggcccaatttccagccagaatcttcatggaattcattatccaagtttagttcgttataacgagcgagatcgcttttcaaagcccgtaatagagaatgcattacaacagatgacaacaaaataacaataacggaaaaatttattaatgaaaaccattgtatctgcgggtcataaatatgtagatacttatcccatctcgtagcccacactgtatcagaggcaacaaatttaacagaataagtgaagtaaacctcgttatccttatcctcgtctagtatcagaggttttcccgttgtagaacacgcgccaggtgacgatctttcgatagatacagggtttacaatgacaccaacaactcggtaattatcgtttccacgatcgtgaaattccacttcaatgtcaaaatgatttacaaagtaaggtaattctaccgttttaactaaattaggcttaacattcttgggcagtcgagcatccaatataacatcctcatttgaggcctctgaagtaagctcttccatcgtactgggaactgctttaccgtcaacggtttgcttaacatctgtaaaacctaactcaaatcctgtgccgtaatagtttgtttttgttctgctatcataagcctttcttgctgctggcaatccatccacgagccagttttggaaaaatccacttttaataagggtgttgataaatttggcatcttttcccggaatcgtgcttttacaaagtgcaacacactctttctcctctaacatgttcaattggaatggggaattgtaaattctgtcaccaaatatgactgaacctaacgactcaggctgtttctcaacgtgctctggtctacaaaaatgaaacctcttattatagtaatcataggagtaaagaaaatgttctttatcgcctgaaacatcgttaccttcctcatcttgatgctgaaagtaaattgatggagtcaagcggttcaccaatagcgggatttcatcgcctgagtgatatgttgtgggagataggcctggcaaggaaaatcctttagttaaagttgcatagcaataaatcagcaaccaaacacctcgtttcattaccgattattaattatcaatatgtgtactaatataattgtcaaaatttatgatgtaaatttagggttcccaacatattttactcaactgtaaacaagtcataatttcctcggacaaaattaggcaaaataacagaaaaaccaatggatgggatgggtaggaaaatgagtaagtaacccaaacaaacggtacctctttattcagtcggctttacagatactgaggtaacttataatggttttttcttatgagcactatatgaatctccttttccatttggataacagtaaagaaacggtgcctccagagattgcaaaaagaataatttcaaatgctatagctcctgtaataacagttacttcaactcctctcttcgacaaacatattcaagaaacgtacaaagtagattctctctatatgctgctgcgattctttggcggttgtgtctctgatagagatcaagccaatgaagcgaaggttggacagcatgagcatgaggtttgtgatgcaagtgactcgacggattcaattcccaaaaataaaaatttggaagtgcccaatttatcaaagaaaggtagtcgcagtaggtcgaatagtcttttccagagggattcaacgcaatctcaatatatcaggtttacaaggccattaggtgacttgatcgaaacaagagatgcaaatgatatgttattcaattaccattctttagaggtattcttagataattatttgaaattggttgcagcaaatactgatgaaatggttcctcataatcttcttaagaaatccatttatcatagtttcttttcactagcaatttcatccacaaataacttatcgccctatgaaacttttaatcaccctattctttccttgattgctttagatatatcaaatggcgaagtttatgaggatgcaagagatcttttagtcaatttcaagaatcttaatcataatactgaaaactttcctatcttcatgaatacaaatgaaatgcttccagttttcttactctgctacaatgacgattcccaagaagaattcgaaaaatgccaggcgttagctaagaaactaaagaagcagttgtttgttgagagtatcttactagcactctggaaggattcttttatttacgacgaaaattcagtcatacagttacaccaaccagtaatgtcatcgcttgaagaaattctcttcttccttcaagctccaactcaaacaacactctctctggctttgataaactcgatctatgatatgcttgattatttggtttatgatttaatgataccattcatgaaaagaaaagtgtcattctgggaagagacaattttacagccaagaaagtcgctatttaatggtgcaaagtttttcaaaaaatttatgaataaaaatcctgtcaatggtaatcaccaacataattctctaacgagagacagccagggaaatgaatacttcgcatcgtcatcttctgagtttttgatgagaaagttagcagattggtctatgatgctatccgacttcaaaactgcttattccacatacgaatcgcttatggatgacctagatgcatttccaaagtacctggcatcatgcatcgaatggtgcgcggtatcactattgatgggtgcgcagagcatagtcaccgtgaaaatgatcaaaaacgatataaatcctcttatcgaaagggcattagccacatacgaaaactgctcacgaatacaacgtggtaaaggcaaagaatcaaactctttggatgttacagagccagtgcgttcgtatgagacacgttgtatgattttggcatctgaattgtttttatctttaagcaatacgtggacatctaccccatacgctatccaatatttagaaacaattctagacgagtgcaagttgggaccttgttcacagataatggtttgggaaaggcttagtgactgctataatttgagagttgaccctagaatcaaacatagagttggagcaatgaagaaggacgctaaagacaccgaagatctccgaggtgagcataagtatagcacagatcatttcacagacgaggacatattatcggaagggttaacaagaagacgcaaggcagctttttttaggttaatagcagctaagaagtgggcagagcaaaaacaatggagacaggtttcttggtgcttaaaagatattgaaagtacctattcagagatcaaatttttgcatggtaacggtttaattttaagcaaactaaaaaatcaactcaatttaaaggacgtggattctgcaccacggccctccgaaaagaatcttacaagaacaagtgttagctttattggatgactttatggaaaattcatgttttgagtataaattatacgtacgaatcttatagatatatatttttcttttaaaactccatttcagctcataagccgatacaaacaccttctatatattatttctctaacagctatgttaacatgattgcctttgtttatctactaaaggacccttctactttatctaccatacgcctatattttctctgtgtttcaatcatatcgagaaaaatttggtacttcgtgtctaaaagaattctatctggatgagttttctcatttggattgacaattcttgcattacccgttagctcttgcataactttccatagaaaacttgtcccgttatatcttccctctcctaggctctcctgtcccacggtcaatgaagcatccttactactttcctcagaggttttgtcaagtggttgttgtgtgcaaatcggaagagaatagttatttattttggcaggcgcacttggagttgaaagttgtagattatgtggggatacaaagccatttgtcgagtttcgatcttccattgataacttttgtatcgacgaatatgaatcgttaaaacgttccgtctttgtctgagaagatttttggcctttgagagttcttttttccctggtataatcaaaatcttcacttgctgcagccccaagcaaggcagaaccaaatacaactgcagcgtcaacgtatcgaggaatcactatcggcaggccagtacaatcagccaacaacctcatcaacaagctatttcgacactgtccacctgacatgaaaatagcatttatttcatgcccactttttagcattacttcaatgatttgtcttgtttgttgtgatatgaattcacaggcactcaaatacataaccgctaagtcttcaattgagttatccatagattgtcctataatacaagcgcgcatattcggatctgctatcggtgatcgattaccgtgatagtcaccataaaaaaacaagtgcttagctaaagaaataacagatcttactttgcgcttctcgaccaaggtttcaagtattttgtttaaatattcgaatttcgacacacctgccaaattagccatatgggatagctcagtgaaagctggatgcgtcgttattaaatgatctaaaagaacgcctgtacagctttggccgccttctgccgcccaaaagcctcttgcaaggacatctctataaggcccccaaacgccatggacaaatatagggttttttgataacaaaatatgacacgtagacgtaccggcaacagctgccaatctgccaattgcaccattgaaatcctttttataattttcggtctcggcaagaccttttactgctgattccggcttggcggctaccgtccctacccagcctgcatatgcatcaataattcctgaacttactacacaatgctctgtcaagcctaattgacaggcagcctttttatctaacgggctgatacattcacctgcggtcagaaagttttttttttcccttaacgatccacccagtctttcaaaatcattcttcgtaagctctgaaagcccaattgaatttaagaattctttggaccagcctatatcggaaccttcgacacccactggtagaaatccctgcttacaaacagcagaacaaaatgacctattctcttttcccgtggctttgaaagtcaagtaatccggaaggtcaaaaaacttacaatcctgaaaaattccagcttctaagttgttcttcaaccacttaatcttcggaatttccatttcaacagacatttgccctcccacatattttaaacatttatcaccagatgagttgatttcttcagtctccttcatcgccctatggtccatccataatatgatattctggtcattattggtaaaatccggtccaactgcaatttcttcaaaattggtagcggatacgactactaaggaacaagtcgcatcaaaaccaattccacgaactctttcagggtcaactcctgattcttcaacaacagttctaacacaatagcaaactgcattccagatttctcttgaagactgagtaataaaattggatatcaattgttccctttttatgggtttttctgctagcgacaacatgttaccagattgatcgataacacatgcccttgcagagcctgttccgacatctacaccaacgtagaattttgcttctggatcttgtggagaaatgcgagaaatcgaggtttcctgtgacgacaataccgctggctcccgtgtttcattttgcatattgttttggcgtttcctgcttttcatatagccttaataatgtactttgcagatgtttgttccttcgtctctttacatcttttcattgtactcagcggtctgggtgtgcagctttccacatttactaatactggtctgtagcatttagtcaaacgggtgttataaaggttcaatttcttcatcatacctaacattgtgatcgaggtttccaggaagagcttatatatatcaaaacaagaaacccagagtatctttacccccacattcaatatgaggtgtcagccataattatttacatgataatactgatattttttctttttcgcgatatattgaaaagaaaaaaaaattgcgaggtgattcctcatcgcatgtattcattttaacgacattgaattaagccttcaggggggagaacaatttaacgattgtgtgagtgtgaatttgtgctgaggataacaatgacgaaaccgcgttacaatgacgtgttgtttgatgatgatgactcggtaccatcagaatcagttacgaggaaatcgcagagaagaaaggcaacgtcacctggggaatcaagagagtcctcaaaagatcgtctactgatacttccctctatgggggaatcatatactgagtacgtagactcttatttgaacttagaattattggaaaggggagaaagagaaacaccaatctttcttgaatctctgacaagacaactaacgcagaaaatatatgaactaataaaaacaaaatctttaactgcagataccttgcaacaaataagtgataaatacgatggtgtagtggcagaaaacaagctgttatttttgcaaagacagtattatgttgatgatgaaggaaatgttagagatggccgaaataatgataaaatatactgtgagccaaagcatgtatacgacatggtgatggcaacacacttgatgaataagcatcttaggggtaaaacattacattcctttttattttctcattttgccaatattagtcatgccatcatcgattgggtccagcaattttgttcaaaatgtaataaaaagggcaaaattaaaccattgaaggaatataaacgtcctgacatgtacgataaactactaccaatggaaaggatacatattgaggtattcgaacccttcaatggagaagctattgagggaaaatattcttatgtccttttatgccgagactatcgctctagttttatgtggttattaccacttaagagtaccaaattcaaacatcttatcccagttgtttcctcactttttttaacatttgctagggttccaattttcgtaacatcaagcactttagataaagatgatctttatgatatttgtgaagaaattgcatcaaaatacggtctccgtattggcttgggtttgaagagttctgcgagatttcatactgggggtatactgtgcattcagtatgctctaaatagttataagaaggaatgtctagccgattggggtaagtgcctaagatatggcccttacagattcaaccgaaggagaaataagagaacgaaacgtaaacctgtgcaagtactacttagtgaagttccaggtcacaatgccaagtttgagactaagagagaaagggttatagaaaacacatattcccgtaatatgttcaagatggcaggtggaaaaggtcttatatatttggaagatgtcaatacttttgcccttgctaatgaagcggataatagctgtaacaataatggaattcttcataataacaatataggaaatgataactttgaagaagaagtgcaaaaacaatttgatctaactgaaaaaaactatatcgatgagtatgatgatttggcacatgattcttcagagggcgaatttgaacctaataccttaactcccgaagaaaagcctcctcataatgtcgatgaggaccgaatagagtccaccggcgtggcagccccaatgcagggaacagaagagcctgaaaaaggggatcaaaaagaaagtgacggtgcatcacaagtagatcaaagtgtcgaaataactagaccagaaacttcctactatcaaactctggaatcgccgtcaacaaaacgacagaaattagaccaacagggtaatggagatcaaacaagagactttggcacatcaatggaattgtaataatatgtaggatagaatgaaaggaggagtcaccataggtgaaaaaaaaaagcacctattgcatataaagtattcaaaaaggtgttgaaagctcttcctgtatatgaccctgtatttaatgtacgcggttaaaaaatttttatatttttaaataagtatcaacttggataatatgatcttgcccgcaaggtggttttatatgaataattactttttttttttttttttttttttttttttttttttaattgaacaatagatgcagaggaatgctccaaaatttatttccttgaacaatattacaagaggcagatatatacttttccttatttcccttagtaaagaatgatgcatgtatactattacaaatttaaacttcacccccaccatggatgcaaaacaaatagaaagccattatcattagtttttttttttcattcaattacgatacttgctgaagaaatcttgatgaaattctttccagtcttgaatccatttagtccctggagccaaaaacgttgttcgcacatgataagtcccgggtctttgtccgaacccagaccctgggacagtacaaatacctgtagattctagcaaagatgtgcaatagaactcatcaggttcgatgccaaggcgttcgctttcacaaagagctttcttaggtaaaacaagcctagggaaaagatacattgcaccctgaggtttttggcattcgataccctctagttccttaaacgtctcgtacaataagtttgctctcgtacgcatttcatgaaaaattttcagcctttcgtcatgatcttgttcataggactcgtctccaggctggggtggtttgaccattaaatcaaccacagcttgtcctgtgacaacagaacatatggatatagacatgagtttgaaaagagcatctcttatttcttgagaaaacccaataatttccatgtaaccgcctctttggccgcactcatccatgaatcctttagaaatggagtgtaaagaggcgagctgaacgttatcgaattttcctggataaagatgctgcaattttcttaggactttcttcatcgaatgaaatttaacatcgttgaaaatgttttcttgatagacctcatcagaaatgattgtaatgccgtatttcgcagcgatcaaacagatcctggcaatggtttcttcagaaagaactgcaccggttgggttacctggattaataactatcagcacagatggtctgatctgttttttcaaagcatcttgcactactttttcaatttcgtcgctgtttgtagaccaatttgactcctcatctaagtagtatggcagcacttgtgcattgaaaagagatgcggatgcagtataaagcggatactgcggaattggaatcagcaggcctgtttgagaatctttacacaataaagataacaaagaagttgccgcggacgaagcgccagtggttaaataaatatcttccggtgtagcgggctcaccgccgtctcttctagtaatgaagtcagcaactgtttgccttattcctggcacaccttgagaatgcgaatatgcccctatagaaccgccaatatcattcaagaggcgctcagctctttccaaggcgtccctggaaaacaagttcaaagaagccagttcattatggcctactcgtaaaatttccgggtactccaggatggccagtacttgcctggtaaaggtcaaaggcttctgatccagttgctgcggattaccaatgttcgcattgataatatcatcgaaaggcaaaacttctgggttttttttcaattcctcttttagctcgtcagctctggttggaatagctcctcttacagcatattctgccttagtgacacctgtattcaaatcttttttagtaatcttgccagcgggcttaaaatccaaatcctttgcggtgaacacacctttcaaatcctgttggtgtgtcattgtcatgtgttcttacttcttctgtgtttaccacttacaaaaacaacactactgtggcgctccttccctttattcttatcttttatgcctctagagatatgaggaaatattggggtatttactgaatgagaaaaggatgatgtcagtcaagaaaggatcaaaaagaaaagtgaacagaatatagttcccacacgaagtagtaaatttagctatcctaaaagtgtattggtaatttgaagagatatgtagatgtacatatgggaccataagagtaggaaaaataaaataaaatcgccaaacaagtaggagaagcctcaagatacaagccgtttccatggagaaaatattgcgaatgaggccaaacttgaactttttttttttctgctaaaaaattcagaaaaaaaatgaaattattttcttaggtataatgaagtaattatgacgaagtactttgagaacccataaagagaagcaattgaagacgtgtggaggacatcagcccgcagcacattagtagaaacaatagtatcgtgatgtgatccctcttggaccctttgccaatcaagggtgaagcgaagccatttaaaacgtacgaacaatggcggtagttgaggtatgggtgaggccgcagattaaatcccggcggcaggagcaaccgcttttaaccagaattgtatgttataaagtatctgtatatacgtgtatatatgttgtgtgtatgtgaatgagcagtggatctaagtaactaagtcctctagttcttcaggatcgaggccttcttcgctgtacactaactccatggttgggacggcggcaacttctttgaagttcttagacagcagtggtaacgctgcaccttcttcttgattccgagtgatgcactcagtctcatctttttcgccttcttcatcaatttgttctagtgggagtaaatcaactttatctggggtgtcatcttcgtcttccaagtcaagcttatatggtgagttgaacgtcttcagcttttcaatatcatcttgttgaaatggggaatagccttctggtacatacggtaacggctcctgcctctgtggtgctatttcgatatcatagtcatcagttttatcacttttatcgtttttagttttttgctcattcttcgtggagttctttatgagttgttgcagaccaccttgctcattaaatagtcctaggccaccatttaattcattttcaccgtcggaggaatcctgttttaaaagtgcactttggagttttttgccaagtttactctcggaatcttcattaccttcatcatcgtcggaactctcttcatttttacctgaatctgcaagatcttttaaaactagacttttcattttaggtaaagcattataaccaaggacagaaccgtacttttgtaactttcttgaattgcttaacaaatcattatggttggccctactacgactgcgagaaatttgcgaaagtttcctgagttggtcgtttttgcgtatagatagtgtattctgtagttgtggtaagtctgcatctttactctgattagaagtttcgggaaaaataaagcttttcgatctattgttgtcttttgctgccagaggcaatcttccttgttgttgcgcatgggtatgcaacctttttgtgggtgacacctccttccctccttgtatgtactttaatgtgttgccattgttgctgttcgcatcccttttgagttggtccaatcttacaggtggttttaaaatattagagtgcgaccttttcagcaagtgagccggcgtctgtggaaagttaatgccggaactttcattccctgtatatacgatattattctctttatcttcgttagctggcatcataaaggtttattatctagcacttaatctagcttggtaccgcagaagtgtaatagtatgtgaatgggaaaaaccgctagcaaccgttacttgccttcgccgaatattgatttaaagctgcatttattttgtttgtttattttgtttgtttttctttttgacctcttacacgagttttttgacgcgtttgagatctttgtgtgaaaacgataagcaacctacgctaacaaatacacacgtcgcacggaaagtgatagtgaagcagatatttctcgcaaatcctatgttatccgtaaaataaatccaaccctaaagtattaacatgtaacaacttaagcgcttccttaagactgtatagatatatatatatacatatatatacataatcatgaaacgcatcgtcgaaaggtcatttgaagctcggatcacgtgatcgaaagctgtaaggaatttgaaaagccaattttcccgtagaagctgtgaggtacaacaagtgaaataactacaggagaaactcactgagaaacgttggaatagaacagtagtaatcgcaggacggaatgccactatttgcaaggctctgccagcctcaatcaagaagaatgttttcatctatatcttctttctctgctctatctgtgttacgcccacaaaccggtatgctcttaaacagttcaccattgaagactccgtccttcacaccgttgggatttggcttaataggtcaaagaagatggaaatcaaggggtaacacctatcaacctagtacattgaaacggaagagaacttttggtttcttggctagggccaagagcaaacagggctctaagatattgaaaaggaggaagctcaaaggtaggtggtttttgtctcattgaaatttcacatactattcagataaatttgaatacttcttgtacataggtatctaatgattatgcaacatacactttcactattattcaaaaataaaagagcagttactttattccactttaaaaagacggttactttgtatgtacatgattttatataaaaagaaagaaaatgcaccagtatatatatatatacaattaaaaaagtccaacaagacaaaactgattcgctgattaagcaaaatcgattacaataccggggccatgtgtgcttgataatgtggttttactcagtatatttggtttcttagatttttgattatcaacagcagttttaaatgccgctctagcggatataatgttttgtaaaatttctcgatcagtgaagtagcatttgccgactccaatgctgatagagtttcccctttgcctgaaaggcatagatcctagactttcttgaagtaaggagcttatatcatcactcaccgtaccttttttgacagagggtaaaaccccacgaggaccaagtatcctggccacctgcgattgtaaagctggaacaatatcaggagttgcaaatgctttgtcaaaatcaacgctaatttcaccgcttttaattttggcaacaagatctgctccgccaatcaaatgatttgggtatttctcacgaagctcttccaatttactttcgtcgttggtaaaggcagcaattttgatatatctcaaaggcttaggaaatgtcacgctaccggataaaggcgctgtacctctttcaccgactaccaatgtagtcaaattaattgtctgttgcgattgcggtctgccaacttctgctgcgcgtaaatatcttagtgcctttgtaacaggcatgtacaatgggcttgctgtagctggtctctttgcctcggcctttcgttgtaccaatcttttcaactctctttttttggcttggtcttttgttagcgaaggtgcattggaggacatagctgctggtttatagtcatctgcgtatagtttttttgcagtatgaaaaaagcatcttcttgcaggacctgtgacacatattttcgggatcgctactacggatagcatcttctttgatgacttatcactgtttagttttcttcaaattccctttatttcaggtcgtttttcaaaatactttggtttttcgaaagttttctcttttcgcttaaaaaggagattttgtcgctagtctcataatgtaagttacactaaaaaatagagaatagtaaagatgaactggatatacaaatatagtatatttttaccgctgttgaaaacatttcgttccctcccatgatacattcatattttttgtgggtttcaagactaccataatacctactttagaaaagcttcgattaggtaaaaaagttctatatgctttgatgtcgggcatttttacgcatttaaacatttatatgatataaatctactttctttttttcttcttcaacttgttctcaaagtctatccatttgcttggaatacctagcttgttaaggtgatcaatgatcgattgaccgtgtggaccttgaacctgcacttcagcacatttgaatgtttgtgattcacttattgttgtcgatccgctacaaatctttcttaagtcagccgcaagtgattctgggtcgacttgaaacacttcaaaattgctcactctggtaataacttttctgccaattttcatttcagtaataatcttaatatgcggaagggaacccttcattggcgccttgaacaagagagtatcatcgcttttgaatatctgatagaactcggtaaaattattggtgagtaagggatgcaaaatttcacctctagcaatgatacgtgaagcattcaagactttcttcttcttattgaccatatcgaataatagatcgtccataataacttttcctttatcttttgtgtctgctaggttcttgacagaaatatactgagaaaccgcgcttctaatgtcctgagaggtgtagtacgtgtgagaagccaaattaacctccttcaaaagatctttggcaagattaaagggtttatacagagtcagtgaatacatcattccagatgttttctccttcgaggttgtgctctccctactttctgtggcagacttgctacaaccaagcttatatggcacaaagttctttaactcatccttgtcagtatttttgcccacaatagttaagtcatccccctttccttttaatttcaagaagccttctttctcgaagtgtttcaaaaattttgcgctttttttccatgaagttttctttacattgacttcattgtgatcaattggaggcaaattacgcataatgtggtttgagatgaagttagaagctgaaatgggtaattccaaacctttatcttgagtcaaggtataatataatgctcttgtaatgaaataatctacatccgacacagtgaaatggtctagaacttcagcaatctcctctacatcaacagacgcttcttttacatcttcttgttccttttcaacagccttgatttgctccgaggattctatctgtttactactgatattgttatcctttgattgagtactgagaacaaatggaggttccaatttcattttaaagactttggagagcccatcattgaaatgatgtatgattttgacagcaactcctgtttcaccaattactttatcaaaggacggtagatctaattcgacaataccgatggctaagacagtttctggtgcctgtttgctagctataccacaaagagtacctattttacaacgaggatcaaagggtgggatcgaaccggaaatcattaagttagcgccgttgaataaatgttcttctataacaaatccatgagttaaaacgatcggcaataacgcaggatattcccaacaagaatacacagttggaaaaagttgctccttatgcttttccttgaataatattggggtattattctcatctgtgtaaaccgttcctacacttttctggccgttaaagttggtttgttttatagtggaagtacgaaagctatattcctcattattcgtttgtttttggaatgtttgtagcaacttctttctttcggaattcttcaaattacttaaagcttttatgtgaggctccttcttaaacatagctgtactaatcctgcgctacactaatctattgagtcggttattcagtagactcatgtgttaattttgacgcatatgtgttatttcacggttttttaggtttacatttttgttttccgtagctagcgcctaagtttaaccaagcataacaaaatggagcacagaatgcgttcaattcgatttatcagaagacgtgacctagggttctgttgaacacgcgtaaacgactcaagacgaaatgtcgtctcctattaatgattatttcattgattataaccctctttttccaatctttgctacaagaattgcgaaaggccttgctatttacagagtctcggatcacgctaggcttgcagtaattccaataagaaatataaacttggtggcgaattacgattgggatacaactactggtaaatttttgtccatcttttttaaggatgggacgatcagaatccatgacatttttaaagacggtcgattagtttcattcctaagaattccgagtacaaaaatatcaaaaggtatatgggaccgaattccattaagatacgaaccaaataatcgagattttgcatgtaacatcattgatgatttaccaaagctaataaggtttgtaaaggactccaaaaggataaacattgtcccttacactcaaccgaatagcttgtggagaggtcctgatgaggatgatctagatagtaatgaaaaactagacgttcacgtagtattcaatgagggaaatgataaaattacagttttttttaatggtgattacgctgttttcttgtcggtggataatattgaaaacgaaaattctttaaaatcaattatcaaagttcaagatggcttttaccagtgcttctatgaggatggaactgtacaaactttaaatttaggacctttattacagagcaaatcatcagtgaacctgctgaattatataatggtaataaaagagcttataggttatatgcttactcatctcgagttcattaaccgggaactggcaacaccttatttagatttcgtcaaaagattgtgtgatgaagcctacggatatggcaaactcaaatcggaattagaagccctctttttacttggagagatctcatgtgacttggaagactggctttgcaattcagtaggtgagaagaactttaaaaggtggaagtatttaggttgtgaagcttaccaaaaaactgttcagattttaactttaatatttgtacccgcatgtgaaagaatcattatttatgtggagaagttaagggcaatattacaagccttttctatacagaataagctcagttatacgtcagatttgacagctgttgaagtgctcctaaaaagttcacagaaattgttaactatgacattaaattcaataataggcttggggagggacgaaacactttttgagaagtttttcatatggttcaacgacagacttcatgaagcgctagatgaagattataaactgaaatttcaatttgaggatgatctttactttggatacgatttactaagttactttgacagaatcttatctaaaaaaggtacggaacctagctcaataatcgacgtgaaactttatagagacctaattaacagcatgtctgatatggaaaaagatattgcacaaagtaatgttaattctcatattcaacagcatattctggttgatttaaaaacggatgtttttgcgcaaaaatatccatcttcgcaaataaatttgcttgatgccataaaattaccaaagcataattacatagtctaccttattcaggtaacaaaacacaacagtgctcaagaacctttctcagaagaaaacaaaaagaaactatatataggtactctgaaagatgagaatttaggcattatatcaaaggaatcgtcagtcaagattccggcgctattcaagagctataggttgagcagtacaaggtttgtgccgaatagggtccatagcttgcttcgggatattggattgtcagatagtaactatcatagtagccacgtcaccgattataggggagaaaactatgaaaacgaggaagatgatggcacaatagctattcctgcttacatcagggagaatagggaaaatgatgatttcatagcatgcaccgcgaaggtatcggtggatggaagaagcgcatccctagtgtttccaaaagaaaaacaaaatgtttgacacatagacagatgacgagtagcttttttttagtatttgcataatgatcaccaataatagtagtaatgaaatgtaagcgtaaatagcgtatgcatcatctcccaagacttttcttttgtatggcgcactatgaagaagtttggaacccgcctgtggtgtactgagaaaaaaaaaaaatttcaagggcccgcaatctcaaaatggagtcaattgtgtcaagtcttttttttttttttcatcgttatctcactttttattgcttatcttaagataatttagctgatatactatatagaatagccgaagtgtcagtttactcagatttttgctacttttgattactttttttttacattttcaaggtaattgacgtcggttaagtagagatggggaagaaggatagacagcgcaagaaactgcgtgagtttgctaaattgaaaaacaggcagcgaaacttgagaaagagcgtgcaaacattgaagaatgaggttcaacgagaggctaaagtcccaagaacttcgaatcaaattgctttaggaaacgacaaaatcgaagagattaacgaaaatagtccattattatcagctcctagtaaacaagaggaggtatcaattccgaaagcggttgatattgataccattgatgcacagcctcttcacgaaggcccaaaaattgatgactcgccccaagatgaggtcaatagcattaaaggaaaacctgcggacaaggctaatgaagacgatcttaagccgccttcacaacatgaagcatgtggaaattcagctttgcaaagctctattacagattttagtgatagatcagtatcaccattgcaaagtattaccagctgcaatactccgatgagtgagcacgagctaccagtatcttcctcaaattcgtttgaaagagctgatgatatgcctgtagtgcaggcagataaccagacgtcaagtagtaaatctttgcacattgttgcaccatctcctgaagtaccagtcagcggagatgaaatcacttcatatggatatggctctataccccagagcatcggggatgtagagaacggattgaatcctccttatgtcgaaaatacatcatctgatgaacttgtacatgatctgacgagaagacggatattttcatcctgtatgtgtacttatttattctttattgcaatggacagttctataatcctagtaattgcgtccaaaattgcttcggagtttcatgagttatggagattatccttagtcatctcagcatacctattgagtaatgctattgggcaactggtatttttgaagctatctttaatatccagtgtaaaattgttgttgtgtattgctcaattcagttttatccttggtggctatttatcttggagttctgcccatttttggacgtttatctttgcccgttgtgtcacaggatttgggggcggttccttaatagcgctcaaaagtactattatgaatcggttttctcaaaagaacgacagtcggtactcattgagtgcctctatgataacatttgctatgggtgtggtaattgggccctttatgatgaacttgtttgattcttctcatggtagcgggtggagaaatgccttcttaataccagttcctttttgccttgtgaatgcctcgattatgctggcagatatgtattctgttaagagcactttatatggacgcccaacgcctacattatggaaaagattcaagaatactctattaagtcctgatttatacgaaatattgacacttacgctattcctactttgtttcgttcaagtgacctcattggatttaacagggttaaagaataatacgatgattcaagcgctactattttctgtaattatcgtttgtggcattttatttttcttgatagagacaagcgatacttacatgaactctgtaatttcaatgtccttacaaggtgacaagcgtttaatatggacaatgataggaatttcattttgctttgcagcattaatgtgcatcatcccattcggtacaacgtacttcatcattgttttaaatttaagcactttacaacttgcagagagattgtccccattctttttctccattgtactgggttactttagtgtttcttatttttggaagtcgaaaggacagaattttttgctaaaatttgttttaagcggagccaccctgttactatatgtggcacttatgggggtaagtttgaatttaccagtatggaagcaatatatatgtttgtctctgccatttttgggctcctctatgatattgaccttgctgtcaaatctttatcatgagtaccatgaacaaagaaagtcacctatcagtggttctatcgtatattgtttcggtgccgtgggggggacggttggtatttccttgggtggttatgtcttccacaaaacattaataaaacttatgcatgagaaggtgatgccatttagcaagcaaggttatcttaaaaaggaccttttgaaaattatcaagcacgctacggaatcttcagattgggtacacgaatcagccccaaagtttgtttttcaaactttgattgagtgttatttacaagcatgtcgaaacgtattcaaactctctacccttttttttacgattactgtcgtagcaatattcattttcaacagaatccattgtcgtagtcaaaattgtttgtcactatcttgaaccggtagatgaaaatgtatactttaaataatacaaatactttttttcttttttcttaaacccgataatacttttgtcgcttagataaagatgcagggaacttcaatcattgtggtgaccgcacaaaggcgggatctgaaaaatgatcgtatggggcgggggaagaatagaagagtgaacaaggggatatggtatccgtgcaagaaatgaatggccagaatagcttgatttttacttgctgaaaatgcagcaagcggaaacccctctatcagtaggcaaccaaagaaaacatggttttgtttatgatagtgttttctccgactaaatgacacttaatatataagccagtcatttttctttcatactttcctcttgcatgacgaaacaattctttttttatttcgtttccttgtctgtactttttagacacttgaccatatcacagatatttacagactcttttaattctaaataggtaaaatgttcttcagccaagttttgagatcttccgctcgtgctgccccaatcaagaggtatacaggcggtagaataggtgaatcgtgggtaattacggaaggtagaaggctcattccagaaatctttcaatggagtgcagtattgagcgtttgtttaggttggcctggtgctgtatacttctttagtaaggcaagaaaagcatgagtttgataagaaaaaaaaatttgctaaaaatgagtgtaacactaccaacatggcgagtttagtttgatactaggcgctatacattattatttatatgcccagaggttacaacagtggctacaatgcaaaaaatatactggcttatatttttcatttgagatctggttcctcaaatatatatatatatttatttattttttacacatacatactgccctcctgattactttaaacatctatattacaaaagagaagcattcttttccgtccattataccgttctcgggcggatccttagtttcttacgttttagctctaacactaatcaaaattcttatgaagtgttgggacgggcttttgggccccaattctttgttggattttcctgatatctcacaatttttagcttccttagtttttcaatattaccgctttgttcatttggtgcgaacgacagctttgagtcatactctgatttgacagtgccactcaaccatcctggcattgccgataaaatcttatagcccgtagtatttggattcattttgcttaagtctttcttctcatcatcacatttctgcatcacataccagattgcatcccatggagcgttagtctttagggacgatggttgggcatgtgtcaatgaacattcaaagcctagggaacctaggcctgcgactacttttttcaagggaggtacttgtaattttattaccgatgcaatatggttaggactgaaatagaatggcgaatcggataattcattcttagctagagatagcataccttcaattcttttacgtgttccatatgtatcatcctggtcacgatgctcttctttattaattctcaacacctcctcgatgaactccttgttgtgtagaggtcctgcatacattggaccagctaaatggtatgtcccctcgcagaacttacatttagtatcaaccggaggcccttgcgcaaccgagtatttggtgaatgttttgttgttcctaccttcgcgttgagaaattctgcccagaggttgattgtggtaagagccgcaacgggaacaatggtaagtagtcatagtacttgacataacgtttttgacttcaatcgggcttgttttgactttgacaaaaactctgacgtaaaagtcaatgctcaacgacaaaagcggttccacagttttcttgtatttcgcggcagtttgctttagtaagttcaatactagtctcagcgcactttcgtgagttgattcatgagaaaccatatttgcaccaccatataaggcaaaacacttttctgggtatccgttaccggccaaaacggataaatcagtgcaagttaccagcattagaccaccctcctcaatactctgaatagccgcatctacaaaaggtgtaacggtaccgtaaggatccaagtcgatgacgtgaaacttattattcgtcgctttgttacggtacattaagacattagcatcatcaaggtttggcttgacaatgttttcgacactattatattcaacgtttcgttttatagattcgacagcctctggaagtaaatcgttagcaataacttccctcacatggggaatttcatgagcatacctaatggctcttaacccagtggctgacaatgcttccaaaatatttatataaggttcgtttcgattagaattaccaacggcttcttttggtgacccgtttcccattttttgacgcttggaagaatcatcgttagtttccgcgcaccttttcttcttactttttttattatttctcttttggccacattcctcaccatataggttgtcccacgccttgatgcatgtaacacttagatctctattaaattgttggatgggattatagaaaacagtttcctttttagggaaaagaatttctgcttttccttccttgactatattgaaatcctcaatattgattcttggtgcaccatacgcggtaaaattcgctttaattttggatatagcagccttcaacattccgtgtaaatttgcccgcttgaggggtatcctgaagaaaccttccatatctacattgtaagaggaaaggtatcaacttatgactgctcaggatctgtaactttgcgatgagcattgaatgcgatgaaaaaaaaataatgctttatccctttggacgaataaagaaaggctcaaattggaataacgttaaaaaccagattcgatcatcagagcttaaaattgttattcatagcggcacaatagcagaagccacagaatattacctagaggttttaggtgaaaggaaggatttttttaattatttaatactttgaaatagaagtcaagcctttcattgcttatttatatcagaccatatatttttacacacgatgccaccaaaaggttggagaaaagacgcccaagggaattaccccactacttcgtatattaaagaacaagagaacattacgattcaggacctgttatttcctaaaagcactattgtgaatttggcacgcgaagtgccacagcaaagcggcaaaaagctgctgataaataaagacgcatcactagcgttacagcgtggtgctacagtatttgttaaccacttgctcctgtttgcaagggaaattgcaaagagtcaagataaaaaaagctgcagtgtagatgatgttctgagtgctttggaccatataggacactcggcattgaagggtccggttagagataaactagatgaataccaagctgctgttgaacagaggaagaaggaaaaactagatagtggtgaagtagatgctgatggcgatatagatatgggtgaagataaggagaatgtgcccgtggaaaaggttaaagagcatgacgaaatagaagaacaaggcgatgcattacaggacgtagaagagtcctccgaaaagaaacagaaaacggagagccaagatgtagaaactagagttcaaaaccttgagcaaacgtaaccccgctatggaaactgtctagtagtgcttgccaccactcccacaggatcgtagtatgtaacttgcctttattacctacatacataataagctatactcatcgtcgttatttgcaagccggggaacccaacgcggcgccaatgcggaaggaaagaaaggggacaagaagttgatattggtggaacgttaacaagaaattatggcgttgaggaagtgtattagcgagatacgatatcaagcaggtttagttagagccactttgtgatttgaaattttttgagatttacttcgttattataaggacatacggtaacctaggctagttaacataattagttgtcacccttcgcccccctaccctatcggtctttcattttccaactattgattagtaaaattcaaacatctttgctccgattagagcaactgaatatactagggattttgggctattacgcattttttttttcaacttcttttaaacaggtacagtttattacgattactttttgctcacgtagaatatggatgattatcacgtaaatactgccttctcaatgggcagaggtaaccagcaggatgatggcaatagtgaaagcaacagcatgcatacacaaccaagcactatggcgcccgctacgctgagaatgatgggaaaaagtccacagcagcagcagcagcagaacacaccgctaatgcccccggcggatatcaaatacgccaataatggtaactcacatcaagcagagcaaaaggagagacaagtagaacttgaaggtaaatcgagagagaatgcaccaaagccaaatactaccagccagagtcgagtttcgtcttctcagggcatgcctaagcagtttcatcgaaaatcgttaggagattgggagtttgttgaaacagttggtgcaggttctatgggtaaagtgaagctggcaaaacatcgttacactaatgaggtttgtgcagtaaaaattgtaaaccgtgctacaaaggctttcctacataaagaacaaatgctgccaccacccaaaaatgaacaagatgttttggagagacagaagaaattagagaaggaaatatctagggacaaaagaactattcgagaagcgtccttgggacaaatcttatatcatccacacatatgtagactttttgagatgtgcacgttgtcaaatcatttctatatgttgtttgaatatgtttcaggtggtcagctgttagactatatcatccaacatgggtcaatacgagaacaccaagcgagaaagtttgctaggggtatcgcgagcgccttaatatatttgcatgctaacaacatcgtccatagagatttgaagatagaaaatataatgatttcagattccagtgaaatcaagataattgattttggactttcaaatatttatgattctaggaagcagcttcatacattctgtggctctctgtattttgccgctcccgagctgttaaaagcgaatccttatacaggacctgaagtagatgtctggtcatttggtgtagttttatttgttttggtatgcggtaaagtgccatttgacgacgaaaattcgagcgttttacatgaaaagatcaagcaaggtaaggttgaatatccccaacatttatctatcgaagtaatatcactgttatccaaaatgttggtagtagatccgaaaagaagagccacacttaaacaggttgtggagcaccactggatggtaagagggttcaatggtccccctccttcttacttaccgaaaagagttcccctaactatcgaaatgcttgatataaatgtcttaaaagaaatgtaccgtttagaatttattgacgatgtagaggaaacaagaagtgttttggtcagtataatcacagatcctacttacgttcttctctctagacaatactggactttagcggccaaaatgaacgcagaatccagtgataacggaaacgcgccaaacataacagagagttttgaagacccaactcgggcatatcatccaatgatttccatatattacttgacttctgagatgcttgataggaaacatgcgaaaattcggaatcaacaacagcgacagagccacgaaaatatagaaaagctttctgaaataccggaaagtgtgaagcaaagggacgtagaggtcaatacaaccgctatgaaatcagagccagaagccacgttggcgacaaaagatacctctgtgccattcactccaaagaatagcgatggcacagagccccccttacatgtcttaattccaccgaggttagcaatgccagaacaagcgcatacgtcaccaacgagtagaaaaagttctgataatcaacgccgtgaaatggaatatgctctctctccaactcctcagggaaatgactatcaacaatttagggtaccttcaactactggcgatccctcagaaaaggcgaagtttgggaatatatttagaaaattatcacagcgccgtaaaaagaccattgaacagacatctgttaatagtaataatagtatcaataaacctgtgcaaaagacgcattctcgcgctgtttcagactttgtccctggttttgctaaaccgagttatgattcaaattataccatgaatgagcctgtcaagacaaacgatagcagaggtggcaataaaggtgactttccagcattgcctgcggatgcagaaaatatggtagagaagcaaagggagaagcaaattgaagaagatataatgaaattgcatgatattaataaacagaataatgaagttgcaaaaggaagcgggcgggaagcttacgctgcacagaagtttgaaggaagcgacgacgacgagaatcatcccttaccacctctcaatgttgcaaaaggtcgaaaactacatccaagcgcaagagctaaatcagttggtcatgctcgtcgtgaatcactcaaatatatgagacccccaatgccttcatctgcctatcctcagcaagagcttatagatactgggttcttagaatcaagtgacgataacaaatccgatagtttgggaaatgttacttcacagacgaatgatagcgtcagcgtgcattctgtgaacgcacacataaactcgccatctgtggagaaggaattaacagatgaagagatattgcaggaagcttctagagctccagccggttctatgccatccatcgatttcccccgttctttatttttgaagggtttcttttctgttcagacaacttcatcgaagcctttgccaattgttagatacaagattatgtttgttctgaggaaaatgaatatagagttcaaggaggttaagggtggttttgtttgtatgcaaaggttctcttccaataatgtggcagcgaagagagaagggactccaagatcgatcatgccactttcgcaccacgaatccattagacgtcaaggctctaataaatactcaccttcttctcctttgacaactaattccattcaccagagaaaaacatctattaccgaaacctatggagatgataagcattcgggaacatctttggagaacatccaccaacaaggtgacggtagcgaaggcatgactacaacagaaaaagagcccatcaaattcgaaattcatatcgtcaaggttcgtattgttggtttagccggtgtgcattttaagaaaatttctgggaacacttggttgtataaagagctggcttctagtatattaaaagaactaaagttgtaagtaacacgttccctgagaaaccacagcttacatttttgatattcgaaaacaagaatatccgttcgatagaaatttatatatatatatagattctttttattctcttttggaaagaagaaatagaatggacctaagcagacactcagcagttaatattttcgtcccttaattggtattatttataaataaatggcacgtactttatgtgtaaagcagttcatcatcgattgatggagagaatttgtatacgtagagcgatcattgcaccgtttaccaggacaggattcatatggatgtaataggactattacttcactgaatcaatacaactcgtaacggtcatataactgcgagtttgtacgcagttattctgtttgtgaagacagattatacttcgccgttgaaagatttctttacttcaccatcattgcctccggattctcttaacttctaaataaaatgaagatactggtaattcttgtccgcaaaaatctacgctacactctggaaagaaacgagattttctaccgtctggtttataatgaatatatttacatgaccagctttgcaatcatatgatattttcgcccatgtatacgaaattaactaaaaatacatccaacgggaggccattttcatcactaatagcttgtatgagctcaggaatcatccagtatgtgctgtagtgcttcatttgcgcttctaatggacttgatatcgttcattacacaagttaaaagaatatgcttgggaattcttttcccgttttccttcggtggggtccttactgatttaatgagcctttcaaaggcttctttggtgtttattcttcgtatcttctccatttgaacgtgtttccatttccgtaccttcacagggtcgtcctcgatattggctggaatatcagagtctgggattcgtatctcaggtactgaaaacggtggcgggttgtagtggtcattgccgataggctgatgaggtccttccctcgtggtgaactcagttggcacatctgctgtgtttgtgggtaactcccctgtgttactgtgtggatgtgtttcaggatatctttgatttaattcggtatacctatgctgcttttttggtgatcttatatgtagatgtgattcggagttcatggaagcgttggaagacatcatatcctgtgatattagattgtctaaaaactgttcaatggcattcgattcattcgtgctcaacaaccccgaactggaaggagacaacttgagaccaagcgcttgatcaaaacccatgcttggttgatgagggttgtgatttagatagtgtgcatgagtatgcaaaggagcatgatgagtttggttatcggcaggtatagtttctacgtgagagggttgcacggttgctacgttaggaattatgccgagctcgtgtgttaacagaggaggggaagttgcactaaacgtgttttcatgtatgtgcgcagacatttggtcgtcgaagttactgctgagcatttggtaagcagtttcaaagtctatatcgttatccagatctaggatacccagtaattcgttcccagttgcttgttgcattttctcctttgctgttccatgtatttatttattgcacgtcaacgagatggaaccgaaccaatttcgaattgcttatgacgccaaatactgattacaataagatatgatgagatgagcctttaatcactgaaaaaaattcacatgtgtgttgtacttggacaggtgtcaacgccctgccgatgacggagggagatagaaaaccggcgaattttttacctcctgctgaaaaaaggttaggttggttccatctgccgcactatggagggtgattcaacggaaaaggcgcaggaagtgcagtagtgaccggcaagcagcatgttgaaagacattgttgggaaatcctgtttgagtcctggtgtgtcttcattctcctaccatttgtagctggcgtagatttggtttgagtgtggttggttaattcatattaagcgttgagattataataatagaaataatggaagaggcactcgatccatattatcaaggattcaaagtaactcagatctgcagtaaaggagagatgcgactgagaacaaattcctttgcaatggcatcggcaatggcacaatatggaactttttcttgtactgttgaaaaacagcacgctgcagttgcatcagggttgttttaagttgttgtagtaatctcgcgacctgagacatccttgaagcggtgcctgcgaagtcttagtgaagagtttaagattagaagtatatagcatcgaagggatggcccaactgaagcaggttcctctgcttgtttctcagcttatataaaggatggattgcgtatgtatacatgtgcatttgtgcgtacgtcatttttcgatagagtcagcttaagtacatgcgtataggtatggaagagcttagaagggcgctggcgctgctaaatggtcaaggatatgagtttatggtgttcataaaggaaaaagaccatttaataagtgagtcaattccaaaaaacttgttctcagagagttttatatcatcttcaattgaaaaaaaccctccactcacgttcgatccattggtaaataggaaaagaataactgtttatgaagaaaatatccaaccagcgatcatgctacccttagatcaacccctactaatacagaattatctgtatacggcttttaaattattaagacaggtcccatgcaaggcgattgctaagttgtggataaaaattattgagccaaggaagaaaaccaggtttccatacattaaaggcaatgctggaaggccggaatggtggccaaaagatgtagaacataaagagccggaccacctccagaaagcggatcgactgaaattgatgtgcacgataattatgaatgttctaccgcaatctcccttcagccttgagattttggacgagcttacaggagtgaccgccgcaatgaccatttttaagaaagaaactgtgaagaaagtaatcatgaaaaatgttttcgaaattgcgaaatgcttgtgcaacaaagatttcaagcagaagaccatatcacttgatgatttaaatgacctagcccaaaaacagaaaaaatcataccatagtcgtcgatttgatgtaaataaaatggttaaggtagaaaaagatttgttacaacagtcaagtggaagcgattcttcaccctcgatgatccttccttcaaaagaaagtgacacagagtatttccccagggaatatccgaaagaccctgtatcggaggattattcgaatagcatatctcgattagaaaatttagtggaatttgatccgttattcctcactaaattggatgaattaactagtagcgatgattgtaaagattttatttgagaaaaatttcaaagcaaagaaaagaggtgtgaggagcgcaaaagcaaaaagggggatagcatacattaacacattttttggctctttgctacttgatttggttgctatcaaggcgatttagtttcgtctgataagaaggacactatagattggttgaatgattctgggttatctaaaaaaagattgtgaccggaagaaggtatttctaaataacttgctccttctagacagttctttaaattgttcaactctttgaccatgaacataccggcttttttattcatccaatcatattgcccatatactatcaataatttcttaacatttaaatattgcagagaatccatcaaggggtcctttgctaggatacatcttgaaaataacgctttgaaaatatctgtcgtaacctccggtatacctcccttaccgtaaaacagttcaaatatgtactctttgtatgccaacgatgggactcggctatatgccgccattatgtaattccaacataacttagctcctaatggtcccatcattctcaaaatgtgaaattgttgttcaaataagtattttggaatcatatttcttttggagtaaaacttggaatttggatttttaaaatcgatagtataaagagtgttggagtggaaattattatttacagaccagatattcctttccactcctagtggggataccaagcaaagtttgtttaccgagtttggatatttaacagcatatttaaaagataaatatccgccaaaagaatgccccacaacattcattttgcccaatttgttatcaatgcgccattgctcgattctgtcgagatagaaatcttcgtacatttgaatcacaaatttattgtgatttgcatttattgtatatggaaccttaaatttattttctccaataaatttgatatctaacggcagaggtgttgttgtattgatctctaaagacggtactgaagacaatccgctcgctggcatgtcaattgagtataaatttcggatgtgcttggacagacctggataatttctgaaaaaagacattgaagatgcggcatagccatgtatcagcaatgttggtgttcgaacagtacttgtgttttcattttggaaatgccattgatttatttcgttgaataacttatcattctttttaataccttcaacgtgtacctcttccataatacgtctctgtaattcctccagccgcatataagttttgtgtgggttattcaaatggcttgaccatagcttgaatccagattttttgacagcattttcctccttgggtctaagaatcctttccaaaatttttctctggagactcttttcacgacgtttaacttccagtaggcttctattactgtggaacgctctcttccacatgtaacatttatatacattcattatctgcctccttaaactttcagggtccatcaagtacctctttattaaaagcatttttcattcgctcatccttaaactggaaaggcataaggaaactgtcagaatatataaatagaggtgtaaaacatgtgaagctctgtggagttctaagctggaatcgaaacagttgtctcaattttagtaatgtccaagggctttccaggaggtcagtatattcaaagccaaaataattaatgttttggtctgaatttttatttttcaaaaatgaggtgaaaacctccaacgaaactttttaattaaaaccatccgatacagaattttaaatcatctaaagcatttattcggcattttatccttgaataacgtactatgcaactcatataaatactacaatatactttctctttaggaaattcgtagctatcaacaaaggtagtgtcattgtatatatacttccgccttcctaaaaaaaacttcattatgcctccaaagaagatatctttgtctcctaacatgaaaagaacaaacaatgtcatggaatctactatttgtgctgctaataggattcgtagttttgatattactttcgcccgtcttcaagtcaacatggccattttcgactttctatcgtaatgtgtttcagcccttcctagtggatgaccaaaaatatcgttggaagttgcatttagtacctcttttctacacctctatttacctgtacctagtatatacataccacatgagagtggagtctacgattaagaatgagctattccttttagaacgaatactgatcgtgcctataattatactaccgccggtagcattaggaattctagccatggtaagcagagctgaggattcaaaggatcataaatcaggctcgacagaggaatatccatatgattacctattgtattatcctgccataaagtgttcgacatgccggatcgtcaagcctgctagatccaaacattgtagcatttgcaaccgatgcgttctcgtcgccgaccatcattgcatctggataaataactgcatcggaaagggaaactaccttcaattctaccttttcctaatttccaacatattctcgatgtgctacgcctttctaaggctgtggtacatttctttaaatagcacaagtacgctccctagagctgttctgactcttaccatattatgtggatgcttcactatcatctgcgctattttcacgtatcttcaattggccattgtaaaggagggaatgactacaaatgagcaagataaatggtataccattcaagagtatatgagagaaggaaaactggtgagatcattggatgatgattgcccatcttggtttttcaaatgcacagaacaaaaagatgacgctgctgaaccactccaagatcaacatgttacgttttatagcacgaatgcctacgaccataagcactacaaccttacacactacatcacgattaaagacgcgtccgaaattcccaatatatatgacaaaggtaccttcctggccaatctcacagatttaatatagtaaattgtcatgcatatgactcatcccgaacatgaaattttttttcactcggttttttctcaccgccatagattctaaccgcaaatgtcgaacaaattcattatacaagcggtttattaatatagaaggtaggacgccgactcgtaaccattagtaacagatcacagctatactcggtcgttcaagtttatataatctcctagttgagaaatccctacgtaagataattgtatattacgatggtgcagttagccaaagtcccaattctaggaaatgatattatccacgttgggtataacattcatgaccatttggttgaaaccataattaaacattgtccttcttcgacatacgttatttgcaatgatacgaacttgagtaaagttccatactaccagcaattagtcctggaattcaaggcttctttgccagaaggctctcgtttacttacttatgttgttaaaccaggtgagacaagtaaaagtagagaaaccaaagcgcagctagaagattatcttttagtggaaggatgtactcgtgatacggttatggtagcgatcggtggtggtgttattggtgacatgattgggttcgttgcatctacatttatgagaggtgttcgtgttgtccaagtaccaacatccttattggcaatggtcgattcctccattggtggtaaaactgctattgacactcctctaggtaaaaactttattggtgcattttggcaaccaaaatttgtccttgtagatattaaatggctagaaacgttagccaagagagagtttatcaatgggatggcagaagttatcaagactgcttgtatttggaacgctgacgaatttactagattagaatcaaacgcttcgttgttcttaaatgttgttaatggggcaaaaaatgtcaaggttaccaatcaattgacaaacgagattgacgagatatcgaatacagatattgaagctatgttggatcatacatataagttagttcttgagagtattaaggtcaaagcggaagttgtctcttcggatgaacgtgaatccagtctaagaaaccttttgaacttcggacattctattggtcatgcttatgaagctatactaaccccacaagcattacatggtgaatgtgtgtccattggtatggttaaagaggcggaattatcccgttatttcggtattctctcccctacccaagttgcacgtctatccaagattttggttgcctacgggttgcctgtttcgcctgatgagaaatggtttaaagagctaaccttacataagaaaacaccattggatatcttattgaagaaaatgagtattgacaagaaaaacgagggttccaaaaagaaggtggtcattttagaaagtattggtaagtgctatggtgactccgctcaatttgttagcgatgaagacctgagatttattctaacagatgaaaccctcgtttaccccttcaaggacatccctgctgatcaacagaaagttgttatcccccctggttctaagtccatctccaatcgtgctttaattcttgctgccctcggtgaaggtcaatgtaaaatcaagaacttattacattctgatgatactaaacatatgttaaccgctgttcatgaattgaaaggtgctacgatatcatgggaagataatggtgagacggtagtggtggaaggacatggtggttccacattgtcagcttgtgctgaccccttatatctaggtaatgcaggtactgcatctagatttttgacttccttggctgccttggtcaattctacttcaagccaaaagtatatcgttttaactggtaacgcaagaatgcaacaaagaccaattgctcctttggtcgattctttgcgtgctaatggtactaaaattgagtacttgaataatgaaggttccctgccaatcaaagtttatactgattcggtattcaaaggtggtagaattgaattagctgctacagtttcttctcagtacgtatcctctatcttgatgtgtgccccatacgctgaagaacctgtaactttggctcttgttggtggtaagccaatctctaaattgtacgtcgatatgacaataaaaatgatggaaaaattcggtatcaatgttgaaacttctactacagaaccttacacttattatattccaaagggacattatattaacccatcagaatacgtcattgaaagtgatgcctcaagtgctacatacccattggccttcgccgcaatgactggtactaccgtaacggttccaaacattggttttgagtcgttacaaggtgatgccagatttgcaagagatgtcttgaaacctatgggttgtaaaataactcaaacggcaacttcaactactgtttcgggtcctcctgtaggtactttaaagccattaaaacatgttgatatggagccaatgactgatgcgttcttaactgcatgtgttgttgccgctatttcgcacgacagtgatccaaattctgcaaatacaaccaccattgaaggtattgcaaaccagcgtgtcaaagagtgtaacagaattttggccatggctacagagctcgccaaatttggcgtcaaaactacagaattaccagatggtattcaagtccatggtttaaactcgataaaagatttgaaggttccttccgactcttctggacctgtcggtgtatgcacatatgatgatcatcgtgtggccatgagtttctcgcttcttgcaggaatggtaaattctcaaaatgaacgtgacgaagttgctaatcctgtaagaatacttgaaagacattgtactggtaaaacctggcctggctggtgggatgtgttacattccgaactaggtgccaaattagatggtgcagaacctttagagtgcacatccaaaaagaactcaaagaaaagcgttgtcattattggcatgagagcagctggcaaaactactataagtaaatggtgcgcatccgctctgggttacaaattagttgacctagacgagctgtttgagcaacagcataacaatcaaagtgttaaacaatttgttgtggagaacggttgggagaagttccgtgaggaagaaacaagaattttcaaggaagttattcaaaattacggcgatgatggatatgttttctcaacaggtggcggtattgttgaaagcgctgagtctagaaaagccttaaaagattttgcctcatcaggtggatacgttttacacttacatagggatattgaggagacaattgtctttttacaaagtgatccttcaagacctgcctatgtggaagaaattcgtgaagtttggaacagaagggaggggtggtataaagaatgctcaaatttctctttctttgctcctcattgctccgcagaagctgagttccaagctctaagaagatcgtttagtaagtacattgcaaccattacaggtgtcagagaaatagaaattccaagcggaagatctgcctttgtgtgtttaacctttgatgacttaactgaacaaactgagaatttgactccaatctgttatggttgtgaggctgtagaggtcagagtagaccatttggctaattactctgctgatttcgtgagtaaacagttatctatattgcgtaaagccactgacagtattcctatcatttttactgtgcgaaccatgaagcaaggtggcaactttcctgatgaagagttcaaaaccttgagagagctatacgatattgccttgaagaatggtgttgaattccttgacttagaactaactttacctactgatatccaatatgaggttattaacaaaaggggcaacaccaagatcattggttcccatcatgacttccaaggattatactcctgggacgacgctgaatgggaaaacagattcaatcaagcgttaactcttgatgtggatgttgtaaaatttgtgggtacggctgttaatttcgaagataatttgagactggaacactttagggatacacacaagaataagcctttaattgcagttaatatgacttctaaaggtagcatttctcgtgttttgaataatgttttaacacctgtgacatcagatttattgcctaactccgctgcccctggccaattgacagtagcacaaattaacaagatgtatacatctatgggaggtatcgagcctaaggaactgtttgttgttggaaagccaattggccactctagatcgccaattttacataacactggctatgaaattttaggtttacctcacaagttcgataaatttgaaactgaatccgcacaattggtgaaagaaaaacttttggacggaaacaagaactttggcggtgctgcagtcacaattcctctgaaattagatataatgcagtacatggatgaattgactgatgctgctaaagttattggtgctgtaaacacagttataccattgggtaacaagaagtttaagggtgataataccgactggttaggtatccgtaatgccttaattaacaatggcgttcccgaatatgttggtcataccgctggtttggttatcggtgcaggtggcacttctagagccgccctttacgccttgcacagtttaggttgcaaaaagatcttcataatcaacaggacaacttcgaaattgaagccattaatagagtcacttccatctgaattcaacattattggaatagagtccactaaatctatagaagagattaaggaacacgttggcgttgctgtcagctgtgtaccagccgacaaaccattagatgacgaacttttaagtaagctggagagattccttgtgaaaggtgcccatgctgcttttgtaccaaccttattggaagccgcatacaaaccaagcgttactcccgttatgacaatttcacaagacaaatatcaatggcacgttgtccctggatcacaaatgttagtacaccaaggtgtagctcagtttgaaaagtggacaggattcaagggccctttcaaggccatttttgatgccgttacgaaagagtagacaataatatatctatccttttttatattttacaatgcttctatgatatctttactaagtatgagttgccaaatagtcagtgtgactgcttacatacgttgaatttctgtatatttttactaagttgcaacagttagataattacaagttacccttacattctgtgggatgtagtcgaagaacatctcagagtaggtcatcaaaagatgcaaatcagctgagcaccccactttcaaaaacattgtaagatatttgagggaaatcgcctctggcccgtttattcactgaagaattaattatgtgcagtagtataaatgaaggtccgtataattcgcccacttttggaaaatcattatcgttgaaagtagatggtgggttcaatgccgtatctatcaatccctctggtagggatattgttttggccagtcggcaaggtctttatattatcgacctggatgatccgtttacacctccaaggtggttgcatcatattacgccctggcaagttgctgatgtacaatggtcgccacatcccgcaaaaccatattggatagtctcgacatcgaatcaaaaggcaatcatatggaacttagcaaaatcttcatcaaatgccattgagtttgtacttcatgggcactcaagagcaattacagatataaacttcaatccgcaacatccggatgttttagctacctgttcagtcgatacgtatgtacatgcttgggatatgagaagtccacatagaccattttattcgacaagttcatggagatctgctgcttctcaagtgaagtggaattacaaggatcctaacgtcttggcatcttcacatggaaatgatatatttgtgtgggatttgagaaaaggctccactcccctctgttctttgaaaggccatgtaagctccgtaaatagcatagattttaaccggttcaaatattctgaaattatgtcgagttcgaacgatgggacggtgaagttttgggattattcaaaaagtacgacagaatcaaagagaactgtaacaacaaattttccaatctggagaggacgttaccttccttttggagaaggttattgtattatgccaatggttggaggcaataacgcagtttatctgattaatctatgcgacgatgatgacagtgaacaaaataagaagacgaaactccagccaatatatgcatttaaagggcatagtgaccgagtaattgactttctttggagatcaagacatacgtgcgatggggattacgacgatcgtgaatttcaattggttacttggtccaaagactgcgatttaaaactatggccaatttctgatagtatttatgggaaagttaactttgacagaggcaagagacttgaggagaaactaccagattatgattattgctcatacaataaggaacctgaaaatagggaaaatgttcaaaagaatgagtttaggcgtttacgagaaaactttgtgacaacttctggattgaagaaaaacaagacaaaccacataacatggctctcaggaattagaatgaatagcgcaacttcacaagaggatttattcaatgagacaaaaatccaaaatttaggagaggaagtaagcgccattggtcacaagttcccaaaagtcgtttttgaaaagatatccgtgtccacaagggaattgtgcctgacgcttaatggcccctggtcagaggaaaatcctgatgattatatattcttacgaataagtattaatttccctctcaactatccaaacaaaggggacccccccaaattcacaattgaagagaattcaaatttaaccatgagtaagagacaagaaatactttccaatttagcaacaattggtcaaaagtatactgactcaaatctttactgcctggagccatgtatacgatttgttttaggtgagaaggttagcctggaggacatcgaagaagggcaagaacccttattaaattttgatattgcagatcacatagattttgaagaattatcgtcactggatagttcatattccgattctcaaaacccggaaaacctttcttcgcaatcagatatagagtcatacaaggaagcactggtattcccagatacttcgaatcaaggtttggattttggaagaaatttagctcttgatacgacacctgttccaaatgggtgtggatcttgttggactgcaacaggtgaactcttctgcttctttgcaaatgagaaaaaacccgagaaaaagcaaaatgcaataattaaactctctcaaaaagaagcaggggtagagaagcatccttttaaaattgagcctcaagttttatatgataaggaagttgacagcagtgtaatcaccgctgctgatgaattgaaagctcgccctaagcggtacgtggacaccttggggctgggaggcggtactaatggggattcaagaacatactttgacgacgagacatcttccgacgattcatttgatagtgtcgcggacgattgggacgatatattgagaaatgatataatagtgagaacaaaaattccaatactaagaggtaattttaaagctttcagctcagtacattcggaatccgggaaaacagtagaatctaccaaaaaaaataagaatttagtgatttccaaaaatttcagcagtttattaagcgaccgcaaagaactagcattagaatacttatttatggatgccacaccggaaggatttgctagaaataacgctttggtggcagaaaagtttgaccttgatgaaattagtcattgttggcaaatattatctgatatgttgatagaccaaagtgattacgatccttatactactatatggaataaccatcccatggggataaagtggttcataaaggaagcgattgtctactttgagaggcaacaaaatttacagatgctggccatgttatgctgtgtcatattaagcgccaggagaaaaaagattccagccagatattatgggcaagaattagagaatatggaaggaaccattgtgtttaatgacaacgaaagtcaaaacacatcattttggaaaggatctgatgctttttccaccaggtctaggagtagcactgttacaccaaatttttatggtaatcatttgagaggaaaaaacattcatggaggagacaactcctcaataaggtccgacgaccaccacgctaggttaaggacgcacaacactcttaatggtagtagtaaatttacggagccggcccaaaagcagggcagccgtgccatttcatccagcccttttcatagtagaatgcctgacatcaaagtcgagcttttacatgacgatattatagaagcttatgaacaagaagacctcttacatttagaggtatcagacataccaaagttccaaacttatatttatcaatattcaaagttactttttagatggggactgcctttagaaagggtcaaaattctaaaagttagtactgatttcagaagttcttatagttcccaaggcatcccccctaacaataacaagaaaagtccttacaatggtgtacttacgcactggatcgagaacaacgagtttggagaagaaaaattcctagcccgaaattgtaattactgtgatttaagagtgacaagaagtagcttcatatgtggaaattgtcaacatgttttacactcttcgtgcgcgaggatatggtgggagattggtgatgagtgcccatctggatgtgggtgcaattgtccggaaatgttcgatgcctaaaagcttaactatcacgtacattttctgcatatttcaaagaaccttggatgtatatgaaaaaaagttcacaggatatatggcttaataagtagtttatttacgattttttaatccagtagaggcatgatagaagacgacaacggaatcattgagcgttggaggcatttttacaatggctcagtaatcacgaataaaagtaggtggaagttgaaatctattattacatattaaaaacttcagaaatacttgaggctatatattgttgtacacttaaccaatcgtataacggagcattggaacaagaaagctgagtagaaaacaggttacgaaagttgtttgttggctcatttgttcaaagtcattaacgaagcgataaaagtaataattaatcttgcacgaacttcgttgatatcttctggcaccaaccaaatcaaagcacccaactttctagcaatagaaatagccaatcttgcgtttgcgtacctttcttcctcggtgttaccaggggtgactagatcataatcaacatagcccggcgcgataccattcagaacatccaataagaagtgggcgtttgataaagcttggtccttaaatgatctaatggtagagtttttaccacctttagttacctggtcttgggcccactttaatatttgagaatcactcatgtctctaccacttgaggataatgtcttcatggttatcgaaatatttctacgcatcaattgccacactaaccctaaggtcagtaatttgttaccatctacaatatcagatccttcgataccaaccaaagaaaatcctttggctctgcccaagtcgactgcatagttggtgttttctaaggctttgaatctggatatctctgcacccgaggccggtcttttgttgacatgtttaaaatcaacagcaccgggcatcaccttttcgtaagcttgcaataatatcaaaccatccttcaaatcatcaaacagcgaaatgacaggtggatcaacgtcaagagagttcaaccataaggtaaagactcttgcctctctctcaccttcggcgtcaaattcttcaatttcaggcttttcctcttcctgaataggctctaatccaggatgtgtattgaatagatgtgccacgaaagccaggtttaatttagggttccccgcaactaatgaacttggggttaaatactttctacaatctagcttttcagcattttgtaaaacttgctcagctctctccattaaatctgtggtttgtaatggtgccttagaacacaaggcggggtccaactggttcaacaagatagtatagttttcaccatcagacacgtcttttgaaaaattggtaacccttctgttccagtttgcttgcttcaaatggtagttaaaccaacgtagtagaatttgctccggaggcaacctcaaaaattgctccaacgtttcatcatcctccaatagacggtataactcaggatgcagcttaatatcaattttacttaacaaacctctcctaataatttgccaaatcaaacccaggatcaaatgctctctaccttcaataatgtcctcggaatgaacattaacaacgacacaaccaatggcttttgcagaattaataacaatattagcattttcactagcctgaaaattattcaattccttacccttcttaggccaattcaaaactcttgtatcgatagtatcaggaacagagtcgttgatcaacttagatagcaccaacccatccctacattcatcaaataattggaaagtatcagtaggaaatggaagcaaatcacctatatcttggtctcccgccaagacgctattgatatgtttagtaaattcacgtctttcttcttcattgatggtatgtgtagtacctgtttgggagccagcaacaataatcttggcttgagtacccttacccttgtgctgtagtcctgtggcagcagtggaaacaataggggttgagttaggtgctacgttgaaagtggtctgtggagcagctcctgttttagattctcttaattttgcaaccaacccgacgtaatcgtccagttcaacacggcctgacgcatccacacccacatgcttcagggtttctcttgcttcgtcataagtagcatcaccatctttggacaccgcttctagagcttgctgtttttcaacccatcctttatcatctaagtcaatggctctgaacttttcaattgtggaaaaaagatcctcttgagtcaaaattggaaattttctctaatcgcagaagagtttgttagtatatgaaacgtttattacaacctaaaaggtagaaaaaactttttcactgtgctcagcagtgtgggaattcgagaaaggcatacatacttgtaatttgacaatattcattgtgttttggtgtactccttagggctaatatatcagcttcttctctgataattttagtgtaaagagctttcttgttctcctgaaataaccaaaatttatatcgataaatcttcattataaacttcgccccgtacttttgatatttttccgcctcccgaggagtgctttttcacatgaaggccatcgggaacaagaagaaaagccgttcacgtaagaaaataggaccctatatccggtcaggatcactcaagctgtatgtaaatgtaatatagacaaagcacctttaactgctaagaattaattatagtgtcggaaatataacataacttgcttacttcctgtgtaaaaaatgtgagaagggatatgattacttatgtttcggtatttccgtgagttgaagttcgatattggataatcttgattcaatctctcgctgtcttctcaacatttgtagtagcaagtcctttatttctttaagttccacggtttcttcagtcactatattatcaggtagtttaaattttacacttttctggaaactagctttgtgtatcttaccttcgttcgccagcatggaattcagtttagtgttcgatttagtaagggattctatgccatttcccacgtcttcctcttctttcttgagttcaactaataaattcttccctttcaatttagctcgaggaaggtcattctcaaatggggcgtccttgagctcagtattagaacagaggtcagtgttgcttttggcatccgatgggagaatatgttgctgctgttgctgctgtatcctttcaggtgacatgagtccattcttaaaccgggcccgtattctcgttaacgaaccatcacccccgattttattttcattactgaatgtcagtttggttggtgatgtagggaatattatattagttatatgatctgagttttggatcttcacatttttattcgaatttttgaactgaggcctatccaggctttgagtttccttagagacatagcccttcagacattccggcgacataatccttcttggtgttacttgtatactatgcttcattccatctgtcttgttaggtgatatcctcataggtggtttcaaaaactctttttggcttgtcgtcctcaaaggggacatactcaatctcacaaagacattgtccttgtcacttggtatattatttcgaccaatcgtattccctatgtcacgtaaactcctgcggttgcttttattgctcataatttgttttattgaactatgtcacatcactgcaatccagtgagaacactgagaaagctctaactagactatacaatccatttgttttgatttcctcttgttgacaatttgcagtatttagagtatatatcattatgtacgtgttataaccgccatgtctcacagtatcaactaaatagagcttctgcgtccaccaattcataaacagagttgcttttatagccattattatagaagaggggaaccgcgcatcgttgtaactcgtccacttgtattatttttgtaggtataccgttgatggttagatattctaagttcggcaaactttgctcaaaaactttaaatacgtcttttagataatgaaggtataagtggtacaaactaatggcatcttctctagtaattttattcactgtaatattctcagtattttctatggtgctttgcagattttcattgaactttcgtacaaacgtttcaataggtacagaatcccatcccatcgcaggtgattcgttgtcaataatgtttgtatagggcatgatcttgttctcgaaaaacatttggtaaaagaaattatgggcttggaacttatttgggttctttaaaagttttgaccgggtttcaggaaagattttttttagaatgacctcgtgaattgtatttttgcaagttgaacaagggcagaaaccatcgaaattcaagcgagttagtgggttatctgtcatgggaaaaaaaagcctgtgatttagttggcagtgtatgtcaaaacgctgtaattttttgccacacacttgtttagataagaagttaatcaacgacacatcgaagtcaaatttacccatgtaatcaagtttcagtatctttaaattgtgaaacacagccaaacaattcattagaaaaaattcgctgtaaaccaatgacgctaatgatagtttctcaatgttcggaaatttccaaaatccttctagcccccatttgacatataacctgtcaaaaccaccttcttcgccagagggaaaatcgtcgcgactgtaccaagacaaaatctctagctgccttaaggtggaagcatcaaatatgtcgatgtattctagctcttttaagaagtcatcggaagcgtcgtactccgcaaggttaagtgtgtcgggtcgcaaatttaataccaatgctttgatcttcataggagacccggtatttttgaagtacttcaatgcgtttatatgaatggaaagtttttctaatcgagatagatcgcacttcaagagcaaccgatcaattttattcaaataagaaccgcttacactgttatgggtgggcattaacgttggtggcgttaatgttagagtttttaattgctttgataaaggttctagccccttgttaactgatgagcgaacaaattgatcgacaaatttcaaattggatccatactcggatagcaatttaagtacatttgtcatcacatcttcatttaaatgccatgtacaacgtattcgattaattaagggacataatcttttcggtgactctgctaatgttctttcgaaataactaaatttcactttagctagtcttctattcgacatgtcgtttttagtattggaatcatcttcatctatgtagtgaaagtttaggacagaccaataacaggttccaaatgagttatcatagtcaccattgatgtgataggtttcattaagaaataaattctggtagatgaaaggtataattgattcataggatcttttgcatacatatgttaacgaaattttatcttcctgcggaattctccaggcaatttgtttaaaaatctcataaggtaacttatcaaacatttttcgggccctttcaaattggcagtagggttatttttatctattttaagacaccaaagtttcttctttttgcacacattatcctactattttctctacgttactttatctctggttttaagaggtgtctgtatcctaattcccgaagtcgatttttttcttacatattaactgataaataacaagagaaaagagacaagagcctacaaaaagtaagaaaagaagctactacaggaatgtgagttacaatgggtttccgttatacttcaagtactataatggcatataaaaaatacaacggagagcatacatatacttaaaagcttggcagaagagtaattttatcaagctaatcctacagatattcatatcccttgtagtattccttagttccgttaaatgctatagctttaatagctatcagcataatattgccatctttcacggccagtttccagagagactttcttaagtaaagctttaaaccagaacaaaatctaaggtcaagtggatcagacacgtcaatgaccctgtcattgaatttatttttatcagttagcaaagtttgaacttgagaaatcttaatgccgtttatgtccaaatcacagagatatatgcatgctggaagtaaataatgagtttcaattttcgtctgcgtactatcggatgggaaccgatactggtaatttttcaacttaggcgcaccagagggtgtatttggcaaatgacttccaaataaggcctcaaacttataggcggattctccagttatgtctacatggatactttggctttccttattgaggattatcgtacaatcagtcgaatttatttgaaatatcaactctctcggatgcttatctaaaaaaggtctcttataacaaagcatattccaggaatcgttatatttttcagtcatgtcaagtttaatctttttatttgctggctgttcacgggtttttgatagcgagtcgcattcatttatgctacagaaatcgtcttcaaagtagggcgaggttgaaaatgcagaagaagctggaaaagtgatgcctttttttgacaaatccttcaataggaggcaaatctcttctttccttgttattgggttatagctaatatgagatttgattagccgctgttcgagatttaaaagcctgtaataacggcactcttttatcaaggcatttcttttattatcatctagatcgatggatgctcctcccagtaacgtcagcaaatctttgaagtactcagaagatcttggaatgtaaggagcagaatgagatggaggccttaatagttttttagatattatcagctcttccacatcgatataaactgtagccgcatatatttcgaaataatttggggaatctccttctcttctaaataaatttttcgctatcttgaatgattgtccaccaatgttggtaaaataatagtccgtttctttcagtaaagatcgcaatcgcggtaaattgtagtacatcgcatctgcgaaaagcatggtatattgtacttcatccttaatctcaattatatatccttgcaaatgttgatagatccattcaaaaacttcggctgatctgtctatgaatagaacctcatttttattagattccatggtatcgttattactgtcatcgttattggaaggagagcgcttcttagaaaaatattcggtgaagaaactaggaccatccgagcttaaagaagcaccgctgattttgaataatgatttccccacctgaatcttatacattttctcgtgtgggagtatttgaggaatattcggatcgaaatattcttgtgacaaagttgctactgttggagaatttgacattttctatatgattatattgggaactttctttgttggtaatatttacgagtgccacagaccggtctttaattcgctatctttcgttagattatggtatataacattcacacataagatatacatttttttcactgctcagactattcaattttattcgagaggagaatccattagaattttgacttagtaagcaattgcggcttacatgattttccaagaagttcagtcgcccgtgcaacaaagacaaaagcaagctaagaaaaatgccagctcagtggtccggataaaatcttaaaaggatacgtttgtaaaagaagcaatgataagccggccagatcgtaataatgaatcactaatataaaactattatatttcagaaaagaggaaaccgagatagactcatcgtccgcttattatgtaagatattgaatccatgttcttgattagcgtaaaccgactgggcaaacaaaaaaacattatttttgaattaacgaaccttaaacaacctatattaagatatatgataaaaatacaatgcaaccagtatatataaaaaaagtttagttgcgtgtaacctaagagatattaactttatattaatattattataataaacatttagttatggagtgttgcctcctagaattagaataagaaattaccagaatatcttattaattgaaataaaacgattttgtggaagctgtattgacggaaaagtacttaaccatttttctaaaaatatattaaagaaaaggttgagtaaattacaacaataaagcggcagcaccagccaacaaagcaccggcagctggcaaagccttaacagcggcaccagtgtaggaggtaacagtttgagtgctagaaccttgttgggttggcttttcagttggcttttcggttggcttttcagttggagctggagaagtggtattctttggtgcttcagtggttggcaatggacaccaggtggtgtattaagtgataacgtcatttacggtgacggtagcagtggaaaccaaagctggggaaactgtttcagaacaaacgtggtcctcacaagaagtgatagtgaccaaagtggtagattcttctgtgacagtagcagtggtaatgttagaagcggcggaggcaacagcggcaatagcagcgatagaagcgacggtagagaattgcatttttaatttgtagttattttgaagcgaacgaaagaagatgtttgttatccttggttttttattctatgaaaaaattttaaaaaagagagtctagcagagagaagtcgatgaagaacaaccacgatccagcaacggtttatatacttcgagagatgactaaaccatcctatatgttgtggaaagtgtacacaaaaaaattgcaaaaaaaatagttagaaaaagaaaagtgagataagtacaaggaaaaaaaaataacaaacaccagaaaaattcctgcgcggtttctgtgaaggggccgttgattcaccctctgcactggtccctgaaagggactaccgaccatacgcgtagccccttttctcactggaaaccatccgaacgccgatggaacacgcgtctaaaagtgagcacggaccggactcgcggatttaaaagggcttccccactgcagcgtgtcctgcagctcaaacccagccatcaattcgaaataggaaaactccttcctttttgagcgatcgtgttgtagcagcacttcaaaacggatgactttctccgcactgaaacgcatgggcagtccggcaagagaaaacaccgcgtcgaagcacggttattcatgttggagcagttcgcaccatgctattgttttgaaatggctgccaaaaatattcatgttgcacgtttcaatgcttgacagaaaggcaatatggcggagaaccagtgtgagttgaccccaacaaatgaaaaaaaaaaatataataaaaataaaaataaaaaaacaaacaaaaagtaagtctccttcaaggacaactgaataggaagtttgagccggtttcctatgcctatagccttggatgagtgaggagaaaacgtgcagttaataaaattagcatactttaggttttaggatgaaactttttctcccacaatccttatttgttatgacaccagagtgcctaattcaatcgaaaaacagataaggggaatttctggaattagggtgacagaatgagctacgtaaaattaacggcaatgcgaagggcatcttcatattatttttctcaccttgctgctattctaattgcatttccgttattaaggtttgccccttctccgaaggtaagctgcggaatttcctgataagtgcattaccccgcataaggttccccttacgataccagaaaaggaatcagtgtcgatcgtattttcggcatgtggattatccttgcacctgttctccggagaaatgttggtttttttctgtaaggggtatgtggtgaggaggtaagccattatcatcgttgccttcattatatctttttattgctggccgatctctgatattatgatgaatattatgaaaagtgttccttttttcttgcctaagtgacgtgacgtctcctttctaggcaagctatgcagccagtatctcgttgaaaattaaagtacttttcttatttacttatttattttatccatcctacgtaccagattgtgcgggacaggtttttattagtttcacagtttaattttcattgaccaaaccagcctccatgcacagtgaatagaacaatgatttgttatcacttaataactggcccggagagtcaaactcggctactttaccattgtccaacactatgattctatcactgtccattatcgtgttcagtctatgcgcgatggtcaagatagttctgtccttgaaagcagtacgaatcgtctcttggacgactttatctgtctccacgtcgactgcggccgtggcttcatcaagcaccaaaatctttgatggaaccaacattgctcttgcaagacataataattgtctttgtccaacacttaagttgccaccaccttcggttagttgggcatctaatccgtcattgctcattgatagcacgtgttctttcaaatgagaaagttccaatgccctccaaatagcttcatcagtgtattggttaatgggatcaatgttctcacgaacagtgccctcaaaaacttgagaatcctgaggtatgattgacaatttatgtctcaaatcatataacccaatctcgttgatggcaatgttgtcgattacgatgtttccctcgctagcctcaatcatcctgaataatgctagcgttaatgaggattttcccgcacccgttctacccacgataccaactttttcatttggtttaatgtgtatattaatgtgcttcagaacaagatcaagctccggcctataacgagtggaataattattaaactttatatcaccctggctcggccattctttgggtggtctgtggccttcaactattaaaggtgcctcgctcttcaaatcagcatattcctttattctttccactgaaacaatattcgtttcaacttccacagtcattctaacaatccaatttaacgtttgagtgatttgtaaagcatagcttaatgataaacccaccatacctgccgttaatgtgccttgttttagtctaaaaacggataaagttgcagcacctagaatgataattgaaccaataagttccaacctatatgctagccaacggttagcattgatagagggatagaacgcactcatgttattatcaatgcggcattgattaatgtgggaaaaccttttctgttgagaataacctctaaccgttgcaaggccacccaaagtctcttggaaatgagagtagattggagacctagtaatagagtctaaacgacgcaactcccttgatgttctcaggtaatactgctggtagtagatgtaaaacacacttagtggaatgataatgaagataaattgccatgtcgtcgcacagataaccgtaatagtgaatgtgactttcactgcattgacgaaaaactgagaaaatgttcttcctaataaagcatccactttgtatatgtcatttgagaatctgtttagaattctaccgattggtgttgtttcaaaaaacgtcattggggctctcaacacagagtttgtcatcaagttgtgtaaatatttggaggcatgaatggtacaaaaaacccagagaacgattgtctggattaatgttgccagtgctgaaccaataccaagtgcaaaataaatggccaagtaacgcgcggcatttggattagatccatagcggctattaacttcagaccaatgtttcaaccaaacgttacccataacagagaggaacatcgatataacaataaacaatatgaatacacaaacgcttttcgggttgcaagctttagcgtactctaggtaaatgttccactttacttttccctgttcacgatgctctcttttagcaatattttcatcgtcaccaaaatcgatgcttcccaaagttgcatcactggccctccttaaacttatggcgtcagagttgccaaaatccaaatcatttaatttctgcagttgttccagctctccttctacaggtatactactttctcgaactgagctttcagaggagtcaccgaattcattcgacttaccgttattttttttaccatagttgttgagcaatttccataatggcgaatcagcgtccttcgtaatctcatcatatgtaccctgctgtgtgatttctccattatctaataatgcaatagaatctgcgatggataacgcgctcaccttattagtggctaataccttcgtttttgtatgtaataaaccatttggacccaacacatgttcgatcaagtgcctggcaacgtgttcatcaacagctgccaaaggatcatcaagtaaataagtgtcagctctcgcataaactgctcttgctaaagacaaacgagctttttgtcctccagataaggagatccctttctcgccaactaatgtcttatctccatccatcaaaattgcaagatcaatagttaacgcacaggccttgatcgttttttcgtaaaattccgcgtcgtatctatgcccaaataaaatgttttcctttacagtaccattcattatccatggaacttgtgaaacataagcaacagaaccatgaacggtggcgaaacctttaaccctgaatagatcacctaacatgcatgacaatagagctgttttaccactgccaactttaccaacaatacaggtcaaatttccttttttagcttggaaattaatattctttaaggctactttgtattccggtttccgttgccataaaaaggtagcatcatctccaatgttaatggctacatcgccaatattttttacttttggtaaacgctgaaccgaatctggttgtagctcttcattggtaaagaatgtaaataatctaccaatagaaacagaagcttcgataaaagaatttaaaaccataggaataatcattagtgggaatgagagcaggttgaacagagtcaaagcagggaaaactaagtcagtagtcaatgctctatcctcagtataaacaaatacagcaaaggtacaacatgaaacaaggaatggtactatattgaactgaaaacttgtcacagccatataacatcctagttttgtaagattttttaactctttgttatttcttacttcttctagcttttccctataaggcttctcccatgcatataacttcaaagatttaatattgtttagtatttcacttataacacgggtcctttcatctttgtacttcatctgggatttttgcaacttcttttgtatcctcatcaaaaatgagttcaatggcatcataataactagtataatcacgccaacccacatggaatttcccaacaacttatacagagaatataagcaaataatgatttgaaaaggccctgaccatattaaatttagccattgtgttaaatcttgtaatttttgaacatccacactcatgagattgacaatgtcaccggtagaggaaagtccagaagcctcattagatagcactaaggatttttgatatattaaagccgttagggcgctcttaatatacatgcctgtgttgaagacattcaggaaatattgatgcaggacagatgtctgagtaaagcccaccagaaacatagcaaacgcaatcaaaaaccctcttacaatgggtaatttttgtgggtggttattttcaaacccttgaagagaagaatggtcatcctgtctctcactgttatagtctgtgacgaacttgattaaaatccttagtagttgtggttgagtaaatgctagaacatcatgaattgctttaaagaatgcggctaaaagcattttagatccaaaagttctgcatatagcccatgataatgaaggatttgatttttgcttcaactcattttcccagtttttctccaatttttgagagagttcttcactactaaagttcctcggtaatttatataaatctgcttccactaagtatttttcatagccagttttcatcaaacctgacatccaagagaaggtaatcctggaaaatatgtttgcgctatcgtatggatttggttttcttcttgttaaagtttgatgtatgtgttgatgtggcattagcggcttctttggaagagcttcaagtaacaggatactggcacatgttattacttggaataacgttagtatgaaacccgtttgtccggaataccaaatgccttcgtaggtgtgtctaattagaatatttattagtttagcaaaattaccgaatgtttcaaaaagccaatagaataaaagtaccgtattggctacaactgatctatcgtattctatccagtgtaaggctaaagcaacaaataaagataacattgtagaagcatattgacttacaatggtaaagttttccgcttcttctttagaaatatttaaagacgcaagtgaaacaaacgctatctccaacagaactagtgccatcctagagacaataatccaattccgcctatatttgatgccagagtgttttttcttgcaaaggttaactaaatctctgataccgaaggttatcatgaaaattgctgatagatttaggatcacaccgtcgatgaagcattgagtaaagtcaccgtaaaaggatataggtccaaacccttcaggagatctacagagcttgcaggcccatgaaacaagattaccagccattttcttgttctttacggtagtacgatacccctaatttattctcaaactgttaattgaaaaattgtaggttgtaaaccagcttccacatagcagatgatcacaagaggttatcgcaccttttatagcagctgctaacttttttcatcaatttcgtaattactaagccgtaaccttccaccgcccaagcatcacaccaggagttacatatttttgtattatcataaagaaacacacgccaagatatctacagaaaccagatgttagcattagatatatatattcgtattgatgcagcataacaagcgtactatggattgcaaagtaatgtagattcctgaccagtagatctgctcgcgcaagagaaacattcatgaactctaacgacaataacagtaaatccacctcacggagaacgataaaagtcttcatttctccatgaggtggaaacgttgtttgaatattaaacataatacttgaacttcttgtgtaatttttattttttaatcgaagtctactccgaagtctcctataaagcgtaaggcgcgtctccaaagtgctatttttcaagatcaattcagcttcaaagaagctttgatacctacggggcaatgcaaaggctgccagtcgaaacaaacagcgaaagctagcccataatttcttgagctgttgattttgattgtgatatttttcatactttagaagaagatatgcgtgcgcacagaatcgatacatttctcataagagaaaacatcaaactggagatcatacatgaatcgaattcctattttggtggagaacatatatcaattgctttccgatttaagcacctaggctcacagcatgaattgttcaactataaagaaaagcttctcactgtcgataaagctgttgaagagaagttggaacaacaagcgaaagtgcaagatgatggtgaaggcacgatggaaaatcaaacctggtccctaaaatcattactaggtgccttcaaaagaacaggcgaacctgaagagagtgtggatgtggataacatgaaaatgctaaatgagagtaagatgttaagagaaaaaatacagaagcaaatgtattttcatcaacctgtaacgttaatatccggttatgttcaaatatcgggggtctttcaatacgattcagaggtaatttcagagtcaaaatttaaacaagatgaagtaaaaatggtaggactagatattgtacctggacatacgacaaattctgttcttgcattggaagatggagaacatttcaaaggtaaaagaaatttaaccaactacctcaactcagattatacaaatgtgaccaatggtcttcttttctcagaaagcggttctaggggaagaacaggtacctataacgaacggaccttaatgatatcaaacgataccagtataaaaacattacctcttcttttaataccacagacgcttttattttctgaaatttctttagaaccaggtgaagtaagaacattctattttaaatccacaaagctgccaaaagatatatgcccaagttattcatcgtcaaaagtggcatcaataaattacacgctggaggttggtgcggatgtactttctgatgataatatcgagaaattttcaaatagagtcccaataacaatagcaccatatattagttcgaatgccgaacagtacacatcacgtctggataagcctgctatcatattaaagacaggtaacataaaggaactaaagccacgtttgtttactcgaaaagtttctacggcttctgctgtatcatttggtaggagaaaatcttctataattgacattgattctccattagaagataatgaatttgtcaagcgtgtcaaaaaaaacttcattgaactggtggaatctaaccaaaatgtgtcaagagatatagacgaacttattgacttgcaaatgggggtacagttcggaaaggatgaggattcttcggatcctgaacccaacgactcacacttttcgaacgaaatggtgacgtctgcagagtctagcctgagaagcgatgctgtaactaagaggagaaaaagttattcggtacgcgataacatttctaacctcgagcaaaagatgtggaacgattgttctctcgttaagtcagatgagaattctaatcttctacctcagctaattaatttacagaacgcatatcaaattaacagaaataatgagactatggcaaaagtatccttatcagcacctttttataagacaactgatgatataaatttagtcattgaattagatccgataacgacgcctttacttaaagtgacttcgttgactgtatccttagaatcgtttgaaattataaatccaaaatataagactgaaggaaaaggaatagggagcaaaccaaaaggaaactcggtgtatgagaaacattttatttgtttcgatgagtgcaagtccgtatcggtgaaattacttcctccaagatcgcctacaaaccagattaccggacaattcaagacagatgtttttcaacataagtggatgataggactaaaatttgtaataattgcaaagacagaaagtatcactttggatcaattttatgaggataaaaagggcatcctattccattcaaaagagaatttagaaggtgaagagtttacatgttacgttcccattccaatactgtgtacatccgaagatttcatgggatggtaagcaataaatgggtgcagtttactcgtataattggttttgcatttgaatccaatccagtaaagaggatttactatactctcttcataaagggtatgtacagatacatttataagttagttaaccggctttattgtcgtaatagtcatctcttgatgtcatgggttgctgtccgtgcgatttcaagactgctcatttcgcacgatgcatattgcttctctaatgacatttttcgttagaatgatcaggtttttgccatagcttgatcagtaaattaatagatgattttaacaattcaagaggcattaaaacttgggcaaaggagtaataatgtctaataccgaggaattgatccaaaactcaataggttttctccagaaaacttttaaagcactcccagtttcgtttgactccattcgacatgaaccacttccatcttcaatgttgcatgcaagtgttctcaattttgaatgggaaccgctcgaaaaaaatatttcggcaattcatgatagagattctttgattgacattatacttaaaagattcattatagattcaatgacaaatgctattgaagacgaagaagaaaataatcttgaaaaagggttactaaattcgtgtataggtctcgattttgtgtataactcaagatttaatagatctaatccagctagctggggaaatacctttttcgagttattttccaccatcattgatttgctaaactcaccatctacgtttttgaagttttggccctatgctgaatcacgtatcgaatggttcaaaatgaatacatctgttgagccagtatcattgggggagagcaatttgattagttacaaacagcctttatacgaaaagctgcgccactggaacgatattttagctaaattagagaataatgacatccttaataccgtcaaacattataatatgaaatacaaactagagaactttttatccgagctactacctataaatgaagaatcgaacttcaatagatccgcttctatttcagctttacaagaatctgataacgaatggaacagatcagcacgtgaacgagaaagcaaccgcagttccgacgttatatttgctgcagattataacttcgtgttttatcatctaattatttgcccgatcgaatttgcttttagcgatttagaatataaaaatgatgtggacagatcattaagtccccttcttgatgcaatcttggaaatcgaagagaacttttacagcaaaatcaagatgaacaataggactagatattccttagaggaagctctgaacactgagtattacgcgaattacgatgttatgacccctaaattacccgtgtatatgaagcattcaaacgcaatgaaaatggacaggaatgaattttgggcgaatctacagaatattaaagaatcagatgactacactcttcgacctaccattatggatatctctttgagcaatacgacctgcctttataaacaattgactcaagaggacgatgattactaccgcaaacagttcattttacaactatgtttcacaacaaatcttatacgcaatttaatttcttctgatgaaacgaggaatttctataaaagctgctatttgagggaaaacccgttgagcgatattgattttgagaaccttgatgaagttaacaaaaagcgtgggctcaatttatgttcatacatttgcgacaatcgtgttttgaaattttataaaattaaagaccctgacttttatcgtgttatccgcaaattaatgtcttctgacgaaaagtttacaaccgccaagatcgatggctttaaagaattccaaaacttcagaatatctaaggagaagataccgccacccgcttttgacgaaacttttaaaaagtttacgttcatcaagatggggaataaattgattaataatgtttggaaaatacctactggtctagataaaattgagcaagaagtaaagaagcctgaaggtgtctatgaagcagcccaagcgaaatgggaatcaaaaatttcttctgaaacttccggtggagaagcgaaagatgaaataatcagacaatggcaaactttacggtttctaagatcgcgatacttgttcgattttgataaagttaacgaaaagactggtgttgatggtttgttcgaggaacccagaaaagtggaagcgttggatgatagtttcaaagagaaacttttgtacaaaatcaatcaagagcacaggaaaaaacttcaggatgctagggagtacaagattggaaaggaaagaaagaagagggcactggaagaagaggcttcgtttcctgaaagagagcaaaaaattaagtcgcaacgtataaacagcgcttctcaaacagaaggagatgagttgaagagcgaacagacgcaaccaaagggagaaatatcagaagagaataccaaaataaaaagctcggaagtttcttcgcaagatcctgacagtggtgttgccggggagtttgctccacagaatacaacagctcaactagaaaatccaaaaacagaagataacaatgcagctacttcgaacatttctaatggttcatctacccaagatatgaaataaattatcctcttaatagaaattttaaactgataagaaattcatgcatagtgtcccaaacaattcagatagattttagcgtaccacagagatcctatcagagagtaatacttatgatgaaaacaaaagtcaatccattcggtttaaaaaaatgacaaacctatatttgattagattaatcaggcgtcaataacgtccttagaagtccctttgctaagactgatatcgttggcaaaagcatgctccgagtttagtatatacttccacttgataaagttgtagcgcaaaggatgcttttcttaatgagaaattcggtatactacaagaggacatccaatcgtgcttacaaaattgccctggaagacatgattgagaagaaatggcgaaatatgtcttttggtcagatagtctgtaatcgcatataacagtatgcttggtttgctctttatcaccacgcttttcctctctttccagcgcgaaccatgcaatggccagctttatgaaatttaaaccataaagtcatatgagaccagcaatcagaccatatatagccgtactatgctataacggataatttgatagatactaaacagttttagttcacatttctcgtctaaaaacaattaatttattataacagactctatagactaaattgtatgtatttttttttttgacaaattgggggcggtagccttccaaagtccaagtgaacttatgttcgttttgtcttcttttctaatgaacaccttcgataaaattccataaatgacggaaaatggttctagttaccacctcttagtgttaataccaagtggagttgcattccctctactagatgtgcatccgttactgttaatttatcatcactatcctggtcgttagtaaggtctcaaaaacgtaaataaacttaaaagataattaaccactgaatgaacatacatttgttttccctggaatataagtctttgttgagatggtggaatcccttctttttcctccaaaagttccttgatgtgatatacgagatctgattccttcagctcaacagagatctccttcccagtcagtgtcttcactttaacaatcatcggttacggctgtaaggaagttaattaccttcctttatttattcctctgtcggaatacttcatttgaataacagaattttggtttttcagctaaaagttgttcgtttgccttcccgaagacgccatcggaatttgatttcatataaatattgatataattatactctgaaatataatattgataaacttaacacagggtgagaaaggtgaagtatgctaccgaccccttatgtaaaatgcgattacgataaagtatatgagcctgctgaggatagcttcctcatactggactgtttggaaaaagagcatgattttttgaaacagaaatttggtaatcgtttggccatcgtttgcgaaattggttcgggatcaggtatcgtcacaacatttctaatgcaaaacaaaataataccgcaggaaaattccatccacttagctgttgatatcaacccatgggcgctcgaagcaactttggatactgcgaagttaaattcatgtaaaagttcttttttagaagtgattcaagctgatttaaactccagtattcggaataatcaggttgatgtcctaatatttaacccaccatatgtgccagcagaatgtgtgccagatgtcccaggatcaagagaggaggcagaccaatggctagatttagcgttattgggtggaaaagacgggatggcgattactgataaactgctacgacaattagaacaaattctttctccagatggtgttgcatatatattattttgtgcaagaaataagcctaaagaagtcattaagaggtttgtcgatacttacaaatggaatgtgaaacttattgaaacgagaaaagcgggatgggaagtcctcagtgtgtacagctttacaaggtgacagttgcaaaacctttcacgttataattgataacctgtgtctttactcaaagcgtataactatatttcggtttataaagaaaaattcatagctatgctcatgacagaatatcttttttgagatcttcaccacaaccatataaatcaactgaccctagtccgtaaactttctcataatgtagataactcaaattctggaagaagcttcttagttgcgtgtgtctctcgattttgtgaatgcctcgtaataatgggagaccatcttttaaagttgtcggtaattcaagatcatcagttttggttatttcgtaatctttgaattctgcgatttcatctaccagcgcgacgaatgagttcgttttatatacgcaatttattgtatcaataacaaagatccactcattcgtagaggtgaagccttccatgttgagtaagagtagcaaatccaaagttttacatacttgcaatattgtttgtggatcgacttctgactgtatttgaagtgattcataaaattcttgcaaattagtttgtaaacagtaactgatcatagaccaatagtcattgaaatgggactctgaaaatcttaaaagtaaaacccttagtaagatccagcagcttcccttgagcttgatatctttggacaccaaatagtggaaaatgcaacttattaaagaggaaaagtgcaacaaatatgcgtcatttggcgataccatcaacaagtacgatattttcaaaaggttttggcacttgtactcgacttcagaatcgcttcctaagttaaacgtgattaaagtcggagtcacacttgaacgcttggagccaatttctaatagtaaatcgttcaagatttttgacttattttctggataaatggaccattcgtaaataatcttttcccaagtttgatcgctgccaattaccgaaagttttttgtcattttggaacaattccgcaattaaaagcctccaacttttaacttttgaacctaaatgggatacgaccgcggccaattctaagacataacctggaatagttttttcacttttgggtttgatataaggggttaggcattgatttacaattgtcgctaacgttgtattaaacttgtctcctccaatttgatcgttgacgatatattgaacacgccatactacaaattctaaatctttaaatgaatcagggtggccacgatataagttcgtaaagtttataaatgcattaggtaggtatttgaaaaacacatcagatatctccctcctaactcgtttttgttctccaaactgcgttttacttacttttccagaaataagggcaacaagttttaatatagacaacgaaacatcagaataaaggttataattggttgctacttctctgaaaaatagcaggaaatccccataaaactcctccattgcagagttttctacagaatccacgtagttaaacaaaaatgcaataatcgattccccgcttaatctttttaacatggaaggctcccctttagttaatttagttgtgcttgacctacttccgtcacgattagaaaacttgacagatgccgttctgttgtatctgataattacaccatacaataaatgtggtattgtaatggcgggtttattgccgtcgagcacatgtactagtgtgactgtagtattgtctgatctaatgctgatcaaattttccagaagttccaaaggttctagtagaaataaggtttccaacagtttcttcgacctaaatttgaacttgtatgagttatgattagtggcgtccaggctagaatcatcgttagatttacacgaaatgttatgggcccaataccagatatctaaacagcatgaaatcacctgtctgaaagattgtagtattacgtctctttccccctgaatcttactttcttcattggaagaatctgacgaaaaaacgtttgaaacaacggattgaataaaatcaccctttagattagacccagaaaagtatccttccctttcctcggtgacaaggtaaccatgtgaaatctctaatagctcttccagaccacccagaagcaaagctattggttggtaataaccaccttctctcttttctagcaaaaacaatctctgaacacactgtacaagagatgcagacaatggtaaaatcattcgaaatatagaattctcaaaataaacaatgctttcggaaagaagcttcacataggccgttacaataagagggcttttcatatttgaaacgctggtaacaaggaaatcgatatattttaaatgggcagcattgtcatcaaaaatgtctagtttaataccattatcgtgtgatagtctgagaaccttcgatacaatatctaacaaggaaactgctattaactcgggctcaattccttcttctgcaatatatttagacgacatttgcagcaaaaatatgacaatgtccttgaaattttgctcagttccatcgagtaagatatccaaaagaatcagagcactcctgatacttttcgcatgtgtattgctctttatatttagaaatctcatcaatgtaaccaacagcaaacttttatatgtggaaacgtcttcattcttccatatggtcgaagattttattgaggtaagctcagtggaaaaaactttcctagtgcgtccattgtttgttttcaaaacataagcaagcatttggaactcatatgtgagcatatcaagatcatccctttcgtctaatctttctttttcgagacgattaacctttaaaatattatcagtcaaaatgtaaaataatcttgaagcagatcccgagtttaatatcgataaaatccactttgaaacggttaaataaaaaggattctggtcatcaaaaagttcgcccaaaattaattcaagagggcgcctaatcaagtttgaatctgagtctaattgtgtccataacagatctaacacgcttaatctctcggatatatcttcctcttccacaaaagtatacactaacgcactttcaataaatttggatggaataaatctgtttaaagtctttaagttcttgacacctagtatttgatggcgtggatcttttaaagatttccatacggccatcatgactactttcaataatttcatcgattcaatgaattccatgcgtgaatataagtagttaccaaaaatttccacaattccaacgatttcttctgattttgcatcattattagattcacaaagcctgggaatagcctcaaatatgctctgagttatttttttatccgaccagcttatgtgagatcgtcctttaagttcttcagactcaggtatcttttcgaaaatagctataaataatttggagctttcattgatattttccaagtcccataaacttgaaagaagcttcttctgaatcaggtctgctattaaaaaagttagatcttctgttgtaaagggtggcaaacgctcagctatattttctttctctaaaatgctagatggattagaaacattggtataaaacccacgtattttggccaaaagttcttcgcagcttacttcatcatcgtgctttagttttgagtgactgagagggagaagggctctctcggggatatagtttaacaatttgttgtacaaagaaaatttttggagcttataaatattgtcgaaatctttatcattagatggaagggccagtaaagttaataatatcaaaggaaggtggcgtacgataatctcttcgtcgtttccaatattaaaatttgttaatacgaaatccaaaatttttaggtttttgatgtcttcaagttcttgaaatagctttccccatataatatttgtttcagtattgtcaaagaaagtacgtgccgttttcattatttgttcgttttgtttaaatttttccgaggaatagagaagtgggatgaacaattcaggaattacaagtgagccaatttcccatctatccattactgccatacttatcctgaatgcagttaacacggattcttcttctgaaagaaggtcgcttaaaccttctaaaagggcgcttaatccatattttgtaaaatatacattactttcctcgtttgctgacttaaccgaggtagtatattccatggagttcccgccgttattgtttagcatgcccccagcagtaggaccgagaagccagttccatattcttctgttcaaagacatatccttgctcaaagtagttctacaacaactcattatcaataactttttatcctcagaagtaataagaacattcaaaacgggagagtctagcctcaacctctgtaataaaaggtccaaaacgctccttttaataagaatatcattttcatcttctaaacaaccgacaaggcatcggataagtagacctggttcaggggttactaaatctttggcagcaggcaataagaccttgaaagcttcttcttttctttttttcctgtctagatgagaatcgttggtttcagtttcacttgggttctcttccgcttccatttttattttatttactagatgaggtacagcattcaacgacggaaactttctagtcaaccacgtgagtccgcccagtcttctgcctttatttgcagtcatgactagaaacaacgtttgccaaaataaggaatcatcatccaagttctcctgcagagtctcaatgagttttaaagttaaaggtaaaaaatcgttgctttcatcatcaattcctggcaataaactagaaatcaaaggtctgatgagcagtcttaacgttgtttgaggcaacagaaggatatagttatcgtaaagctctatcaaatgtgacctaacagacatagaggcataagtcatcaaaggtaaaattcccgggatccaaatgttacattctgtagccagagtttcaaggccaatatgttcaaagatatacgtatatacttctaaagttttctgatgaacacctgctggtaacgccggcgataatgaggatgtcaatcttcgacttacttgatatggagaaggaacatagtaccttacattctgaaatttaggtgaccagctttgcaacgcctttaatagtgttcccaaactagcaatatagtccgcccattctgttacagagtcaaatctttctaatgctcgctcgacattagcacgaaacttcttctgtttggagtctagttgtttattatttgagtcaattgtaaggggctttagtggtaaggacattttttgtcgatcctctcagaaaaagctgctctgtcggctttttatttcaccgttataaacataattgggaggcttgagttttatattaggtattgctattgttccttttccagtgagatcgaagcttagcctttgaaaaaaccaaaatcacttttgatcacgtgcctcgggtggaacgcccagcaaatatataagtatgtcgtttattaataaaacggtaatcggactctaaatattccttctttcagcactcgcttatgtcgttataaaaacttgattaatttgagtaattagcagtttttgccgtaggtatgtttttagaatgttcttttgcacagtcagaagcgttgttacccataatttcgtgttgagaatattaaataattacgtaaatgatctgccaaatgctgacaatgattgaaaaataattttaaagtttaaataatgcaaaaaatttgtgtaaaaagaatatgtgtcaacctaagccgttccatacaaataaatttccatcccatgcagttgaagccacatatcctggctttccccacaagctccagtcagctccaaatacgaattctgaatgctgtgtgaaattgaaaatggaacctttagtagcatccgtagagttagttttatatgtttcttttgcaccatcgttgctgagatctctccatattcgacaggtcatatcatatgaagctgacattaaaatattggaatgatgaggggaccaggtaacttttctgattgccagcccgtgcgcattagggatttcattgatgcatgatgaattgtgaagttggccgggcacagtcctcttgatagtcgctgattcatttttatttagcatcctaatgtcccagattctaatggcattatctacacctcctgtggcaactacataaggtctgtatttgttgaaatcgcaagtcaatgcttctagtcctgaatgcactaaaaaattattctgatttttgccggaaggtagtctaatgtcaaataagcttgcataagaattccctgaacaggataatacgagattttggtcgtggggcgagaactgtgcttggtatacacagttcctgttttttgaaatacctgtaaagcttttctttttcaatataatggcgtttaatggatccaccattttggtaatctctaaaggtcgtggagtaagggtcattaaactttgctttcttagaggggaccatatttttatagatccatcccatgaactacttaagaaattctgcctgttgactaagttccaattacaactgaatacttctcgttcatgctctttaaatatagcaataggaaactctttaaaggttgtatcaaacaagcgtaatgtaccatcgccctgtgcaaccaacacttggttttcatgactttcgttccatgcaagatcaaataaacaatcctgtgttaaaaaggaattaacttccactattctacctgaacgatcaatctcaaggatgaacaattttccattcccaaccaggccaaagtttgaaccagcagctaccgcgagcctgttatcgaaaaagggagaatactggacaccgtacccactaaaaccttgcatatgatatctgagcatgttgtataaattatgcaaaaagttagatgatagtccgttaacaatatgagatctctgcacttttcgagcgtcgaattccaaatcagaaagaaaacgatttcgacctccggtaaaagattttatggtaagaaaacacagtttgtgttccacagttcttaaaagtgttttcaccttttactgttttgcgaaacgacttttcagaggaggttatgtcggtggtttaatttctcggccttcatatttacttgctggagacatgcaaatttctgattaacaatgattatagaactttaagtagaagtaaagaaaaataagtatatgatatatatatataaagatgcagataaaaaaaaggtaaaaggagtagaaaataatgtctgaaaatggatgactgccaataggacatattttcatattaacatacttcagaagcggtattgtttattgtgatgatcgttgctcattgttatcattagggacgtcgttatgaatggtggtgtccgaactgcttgaaccttggccttgagagggattttcgtctgtaggaggaaaggcagcagaattgttgttgcgtagttcgacggtagtaacatcaccattttgatttctataactggcaacaccggaggaaaacaagttatttctgttgttctcaccagtacttccacctcgttgttgatcattgctatggttattgtcgttattgttgtctcttgagccattcgtaaaatggcctgttaatcgtgaaatattttccaaaaaggaacttccttgcgttgtatcagaggacgatgagtcattacgtccttggttgtgaacagtttgtgctccgggtgctgttgttgcagaggtatcagaagttcccctctgagcaacgttgaatatgtgatccaaaacggctcttagtctgttgtggtgagggtctgtagcgtcactactagtgttatttgagtttggaccgttcgctgctgatgggcttgccgaagaatcagaagcggaaggattcggatttggactgtggaattggaacaaagtcaaagggatgggaacccagcgcggactttgattgttattcgaaccaccagaattagagggtggattttgagtagttgagctcggcccgttgacaccgtttctatcgctatcattaggcggtaaacggactggattgtgtaaaggttggccgttttgaggcactaaaaaaaagcctgttcttgataacatctgttcgccagaacttgcatttccgatagtgggaaccgttgtattggacgtgttttcggatggggcggaactattttcgttagtgctattcactgcagttgggtcgtataaaactcgtctaatacgttcaaaagcagcttcgttagctgctacttcatccgtatcttgttgggctgcacgttgaacacctacagattcgctgatcttttgtctacaaaggggacaagaattttctaatcttgaccatttgtagatacattccctcccaaaaatgtggccacaaggtaacttgattggtgagtgtttgtagcttggatttgtttcttcatcattgagagtgcgttgttgttcagtgagaggaatagaaggcggttcaacaaccgtagcatttgtaatcgatgggttactgtcattatcggcggttgtgcgtaggggcgcaccttcattatccttccttttttttgttccttcagattcctcctcattttcagaatccctttttctttttgctttagttgaatcaacttcatcttcatattcgtcataacatatactacataagggcccttcggccttgggtagatcagaaacttgcagaacggggagcttatcaaactcatcctttgatattccttttggtctatttaatagtctgttgaatctctccattgcaagctgagcagcaacagatatgaagctgttcaaacggtcttgtggagtagacgcaggaacatcacgaaaagataaaacaagagcaccgtcgggttgatggcccccatttccgatgccaaagctgggcccagtaccgttggcaatcgtgctaccggatgctgcgctgttgttttcgttattatcattattagatatattgctcaaatgtgctaatctctccggagtgaaataggaatactgaatggaaacggttatgtttcttgtttgctcagcaccaccattgagtggaccggaagctgcatttgaattattattattttcagcattatttggtgatgtatttgtgcctctgttttgttcttgaccactttcactcataatgaacaaaagctgaggttacaagactatgagagaaaacaaaggggaaaaaagggagaaacgaactatcctgaaatgctaaataatttctatctatagtagcttcactagaggatatatatgataaactatatttccttcaatatatagtttttagctattatttcattattgatttggtgatactaatgcaatgtagttatatgtaaaaaattctttcatattttttgacaatggcagatagaatgttttacccggctttttgcgtcgaagtatataattgttgattaagaagccagtaacaataaaaaagaacagtattatttattttacgttaaaagacgcttttctttcaagtaatgtacaatgttatacctccagatatacattgcaacttttaaagtctagtaaatgcttatatggagggagggatttatcaaatgtgatgaaaaatagctgtaatgaacctggcgaaaaatggaggattcagattgtgtcctccgttttcttttctcgtagatgaacttgaggtgggagataacattcctgttgaggaagtacttgaggtagattttgaaatagagagagctgtcgtacttgtttgggttttttggcctttggagctggaagaacttgttgccgaatgagacgtggaagcaaagtacgatatactggagttagctgccgtggaaaacatgttgccgccggagacaatactttcatatgtagaccaagtgcttgagtaaccaggtgctttaagagcacttggaaccgcgctctctataatctcaatgtattcaccgtcgtcgctgaagttagcctgagccattgatatctccatattgtccagatcatataccacgtaagtattagctaagaagttatcacccaaaataatggtcggatctgactgcggtgcaatacctagtatacaaatgtttgaacgactatctgtgactagctgaaaatcgcttaaccaattagaaagatagaatccaccaaaatcaaagatgatgctactctcttcttccatctctttgatacaatccattatgtagtaaccatatgcagaagagtaagtagctccgacctggtcggcaagcatttttaccagctcagttggcatatacgatatggtcgtacctgaatctagcaggactgggatctttgtagtggttagggttgtcagattgtcttctttatcccctttcgacgtacctaatccttgtaaagtgacttggaattgaattggatccttgtagccgcgatgctgcaaagtattaatgatgggaattgtgtataggtcgcccgcatattttccatgatccacagcgccaaacaaaatggtaccatgtttcgaatcagaatcatttgcgaataaagaataagctgttgattttattacacccgaattctttagcaccatcggaaagttattgtaagtgtagcttttttgtacagagctgagagaaacaccagaataagttgactccaagccaggcaaaccaatacccaagacaccaactgttgagtttgtttcgtttgctacagcaaatgataaacccgtaatgttcaaatcgttcaagctcaattgatcatggccccaggtaccagatgcaaaagtcgtatcaccataggcgatcgaaaattctgtattattggagttgaatgtagacgacttagaggtattaaatgtcccgtatgtagcgcagtcaattaactgtgatgtagaagctgtactatcaaaagtagcagtggcttcgctggtaactatagtggtgtcgtagctaatttcagtaaacacactctcaaccacgctagccaaagcatccttgtttacttgtttaaaggatgagccagtggtatccttctttttagtggaacagtatgggttgtctgaacccgtgacccatagatcagaagaaccagtgtcgacaagcacagtaactttttgaggaggggtgccaatatctaattccaccgaataaaaactgttttgattagtcagttccaccagctcgtaatcatcatctcttgtcatcaaacgcgttctaccttttgtatcatccaaagcgttttcaaatgaactgccgtatttcttctgaaaattcattttgacatagacttcattacttggtaaggatggaaaatctgtaacaccggcatctactattgagctgcagacaagtaatgcatctacgacaaatgtgaggacagataatttcatagagctctttctttttcgtttatttttgacgtatttgctcaagcgaataacgacaaaagcttgttctctcgttgatacttttagccaattacaatttcttagcaagaacgagtgacgccaaccaaatttctcccaaaagtgattatctgaataatgaaagatggtaggaaataaggtattgaaacaggttcaaaactttaaaagaaaactgccaaataaactttctcgatgcgtagctgaaatttcaacttcaaaaaaaaaaaaacgcgtgtaactttctacgtgcaaaacgatgtgtatgaatcccgtcttaattagtaaatagggtctagtaagcgtagcgaggatgaattaaatgcattgttgaatatgaagagcaccttatggtatataaatgtacaatcttgattcatgacagctttgcaagtaaacgtatcaaatgaatatcacgattttggctgtattacccgggcagtatacgcggcgaattttgttaaaaaatgtgttagacttaagtcggagcaaatgaataatgggcatatatagcgcataggttcgctagtgtaagacaggagactgtccaatagcattcgaatcataaccgaatctttgccagtgtgtgtataaaatacgacaatgtcttccaatccagaaaattctggtgttaatgcgaataataatacgggcactggtaacgctgatgcgatcacaggagctcagcaaaatatggtactgcaaccgagacagttgcaagaaatggccgctaagttcaggacattactgactgaagcaagaaatgtaggtgaaactactcctaggggcaaggaattgatgttccaagccgcaaagatcaaacaggtatatgatgcccttacactgaataggagaagacaacaggctgcgcaagcctacaataatacttcaaattcaaattcaagcaatccagcttctattcctactgaaaatgtccctaattcatcacagcaacaacaacaacaacaacaacagacaagaaacaacagtaacaaatttagcaatatgataaaacaggttctcaccccggaagagaaccaagaatatgaaaagctatggcagaatttccaagtccgtcatacgagtataaaggagaaagagacctacttgaaacaaaatattgataggttagaacaagaaataaataaacagacggacgaagggcccaagcagcagctacaagaaaagaaaattgaactgcttaacgattggaaggtgctaaaaattgagtataccaagctgttcaataattatcaaaacagtaaaaaaacattctatgtagagtgtgcaagacacaatccggctttacataaattcttgcaagaaagcactcaacagcaacgagtgcagcaacaaagggtacaacaacaacaacaacaacagcagcagcagcagcaacagcagcaacagcaacagcaacagcaacagcaacgccagggtcaaaaccaaagaaagatttctagttctaattctactgaaataccctctgtaaccggccctgatgcactgaaatcgcagcagcagcagcagaatacaataactgccaccaataatcccaggggcaatgttaacacttcacagactgaacaatcgaaagctaaggtaaccaatgtaaatgcaacggcatctatgttgaataatataagttcgagcaaatcggcaatattcaaacaaacagagcctgccatacccatatcggaaaatatatctaccaaaacaccagcaccggtagcttatagatccaacagacctacaataactggaggttctgctatgaatgccagtgctttgaatacaccagcaacaactaaattaccaccctatgaaatggatactcagagagttatgtcaaagcgtaaattaagagagttagtgaagactgtcggaattgatgagggtgacggtgaaactgtcattgacggtgatgttgaggaattactattggatcttgccgacgattttgttactaatgttacagctttttcttgtagattggcaaaacacagaaaatcggacaatttggaggcaagagacattcagttacatttggagagaaattggaatattaggattcctggttattccgcagacgaaataagaagtacaagaaaatggaatccctctcaaaattataaccagaaattgcagagtatcacatcagataaggtagcagctgcaaaaaacaatggaaacaatgttgcaagcttgaatacaaaaaaataattatgttacccacattctccactcttccacagaaaaaattcctaaagttatagttcacattgttatatatgtatctataaagcgaaattttttaaaattaattgattaattaatattttgtatctaaagtgttcatactatattatttacttagattatacataattaaaaaaaaaaaaaactttttttccttgttttcattttgtttttattattaaatattaaaaaaagtgtccataacatcaatgtttttttttacctttgattagttttcattggcgaaaccataatccccgttccattcccatcataactacgctctcttctgagttgatcttcaagcttgaacatcaactgtccattatgatccttgttaatattttctttgattggactactagaaacacttgaagttccatcttttcttggtcttcctctttttcttggagaccttttaattaccacgttttcatactttttaccaccgctgcaaatcattctacttctgtgcacaaccaaagcgtcttctctattgaatttcttaccacagggacatgcatacgccttttcttggtgcgattttttgtgtcttatcaagtcatgatttcgtacaaatgccttatcacatccagggtgatcacaggaatatggccgatcttccaaatgtgtttgaatatgagatctgatgttataccttctcttgaatgtttttgtacatccaggaaataaacattcaaatgttttatcaggcatttccttcacatatttatcgattgaacctctgggcagtgttgtgagttttcttgtgatttttgagggactatttgtggtatatgtgttgatttccttaatgtgtgtgccgaattgaggagatcttccttcgtacttactttgtgacttaagaacgggagaaggcgtttcggaaataacaaatctactttcaggctcattttcctcattatcatctccttcattgtctgtatttttcgtaagtacattagggtctaaatcattgaaaacgccttcccgatgtcgtgcttgctggctcggcggctttagatgtggtgtcgcagcattgatacccaatgcattctcactgatagagctaaagtgtaactgcttacctcttggtgtatattggtctatataactggaggaaagggatactttattgactgatggagtattatttacagacccaggaattgtaggcataatatccacagaagcactctttaaagacactgattttgtaggagaaggacctggttttccaagaagttcaatacccaggcccaaaggtttctctgaatattcgctttcctgatcttcaacattaatcttgaaatctaaccttaagttattaggggtaatgttagcagagttggacgtagctgaactaactctactctttggagtgaagggcgtaataaatttggtttttgaactgaggttttcatttggattcgagcgaattttctttggtgaaatgagggagtcattgaaaccttcgttcaattcctggaaacatagtggtcctacagtaccactagagttttttctctgcaggcagtacttttgtctattgtttctcctagaaggtgacccagtgaacgaagtattagacattggtggggaaatcattggtgaaaggctatttgcgtatacatcctccacattttctgaagcaggagagatcttccttttgggagataaaaactgtggaccatcagagttctctaaggtagcctgtagttgttgttgcttgtattgtgtttgtttgagttctaactctaacttcttattagcctcttgttgtgctctcaattgctcgcgcaactcttgttgttgctgtaacagtaattccccgaggtttctatcgaagcctttattaatttcacttttgtttatagtcgacaataaattatccgccatggaaatcttcttttcatcgtggggcttatcactcattgttttttgataaacagtcataccactgtcttgatttaatctattttcattcaacaagctagttgcatttagagtcacttctcttgaattattttctaagtcaaagttcatactttgccaatcatttcctattaactcggagaaagtagaaaccttgacagatttttcatcagaaagtggtcccagcggaaggtttaagtcatttatttcattcattataacttcgttggtttcaccatagtttaggttcaatatattgcctaaatcatctgttgctagtgttttatattcgccttctattgcataactcgaagggtcactgcctctagcatttgagtaataagagttggtttgtaggtcaaaatttaggctttgtacttttgaggcatcaaaccaagagtttgatgtatccatctttttcgaaaaaacaatgacgttaatattttatttgattgcgctttaattatatcgcagatgttaaacacgttctcaggatctatttacctagctccaagaacgagttatatggtggtatctatattgtcgttctcaaatctttcttccaacgatgcctttttgtcttccgtgccaatacataaatagtgaataaaattgcagacgatcctctatagtactcaatcattgtttatagagcagatctatagggagaaagaaagataattagtcgctaatggtaggtattgttattgtttacctttttcctaaacaggttaaagtacgaaagtgaaaatttcatcctctctacttgcccggattgggattcagaccaagatatttccaacaatgctgctatgaattggaacagagatgttctaatgaatatttaacaaggtgtgagcggagtgtaccactcctatcggctttcagataatcatactacctttcagaatatctaacaataacactccgatatttgattcgctctcctttaagacagaaataacattggccctagaatccaatgccgtaaatatctacttgacaccatttaatgaaagaactgtctgactgccgaagttttataagtagtttgactatgtttcataagttaggccactagacagcatgtgaaaacggtgatgatagtaaaaaaatatcgtttgggttttggctacccggaggtcgtttgcaaaagaaagtgtatgcaaatctacaaaacaatagatgtcgttgttgagataacagattggcacaaaattactaaattgttgtggtacgcagctatagtttgtacgaaagtagtagcagaaattaacagatacagatctgcaatttggcataatgtacaccaattattcacttacaagcagtgacgcaatgccccgaacttacttggtcggcacagcctcaccagaaatgtctaagaaaaagcgccagtctgcaaattgtgacaagccaacgaggagggtgatccacatcatcgatactaatgagcactcagaagtcgacttgaaaaatgaactgccaataacatgcacgaatgaagacggtgagatgacatcaagctcatggacttcacaaaccgctaatgattttctcaaactggcatacgtaaacgcgaaattagacccgtctttgccatctcaatatttcaaacaagatatcataaatgttttacaaagcttggagattcctggatggtctgtgcccggctctaaagaatcctcgttgaataagaatttattaactttgacacaaatcaagggggcccttacaaatgttatttataagattcactatccaaacttaccccctttactgatgagaatttttggtgatagcatagattctgtaattgatagagagtatgaattaaaggttattgcgagattatcattttatgatttaggacccaaactagaagggttttttgaaaatggcagatttgaaaaatacattgagggttcgaggacatctactcaagccgactttatagatcgggatacttcaataaaaattgctaaaaaattgaaagagttgcattgtactgttccattaacgcataaagaaataacggatcaaccgtcatgctggacaacctttgatcagtggatcaaattaatagactcgcataaagagtgggtttccaataatgtaaatataagtgaaaatttacgctgttcaagttggaatttttttttaaagagtttcaaaaattataagcgttggttgtataatgattctgcttttacctcaaaattattaagagaggatgataaagatagtatgataaattctgggctaaaaatggtattttgccataacgacttacagcatggtaatttactttttaaaagtaagggtaaggatgacatctcagtgggcgatttaacaattattgactttgagtacgcaggccctaaccccgttgtatttgatttatcaaatcatttgaatgaatggatgcaagactataatgatgtgcagtctttcaagtctcatattgataagtatccaaaagaagaagatattttagtttttgcacaaagttatataaatcacatgaatgagaaccatgtcaaaattgcttctcaagaggttaggattctttacaatctaatcatcgaatggaggccttgtacacaattattctggtgcctttgggctcttttgcaaagcggaaggctaccacaacgaccactgatagaaggtgaaaaactaatgagcgaaaaggctggactaggtgatgaaacgcaccttatggagcacaaaaataaagagaatggaaaatacgattgttctgaagatgattcgttcaactatttaggattttgtaaagaaaaaatgtctgtcttttggggcgatttaattacattgggagttatcgacaaagactgcccagatattggaaaaacagattacttagacactaaacttattttttaagctgtatacacaatcaagtatttttctattcactgcgataaaattgtgtttttcaacatgttaggtcaatggaaagtcattattttgaagcaaaatgtaaaaaaagaatattattaagagaataaattctttcaaaaatgtagagcaagttatgtggaaatcaaaagaatattagttgattctattatataataaatagttataatcattgtattttgatgatgaaaattcagtatctaagagttatagccaagagagtaatttttaatacttttttgcgcttttccatatctcattataaaaagaaaacattaattcatagttccatttatcatcatagcatatctttaaatatcatacttaaatagaagagattcacacagtaatagcggacaagaataatcatgaaatcagattggtatgggctgcaaatttcaaatcaccataacaacatttttctagggtcttcaatcaactctttaacagtcttcaagaaggtaacagcttctctaccatctagcaatctatgatcataagtcaaagccaagtacatcattggtcttgagacaatttgtccattaacagtgacaggtctctctttgacaccatgcaagcctaggacggctgtttgtggtgaattgatgataggagtaccgtataatgaaccaaaaacaccaccattagatatggtgaaagtaccacccgtcatatcttctagggttaatttgccatcacgcgctttatgactcaagcgaacaatttcgttctcaatatctaaaacactcaatgactctgcattacgaacgacgggggtaaccaaaccctttggagtggccacagcaacagaaatatctgtgtaatcacgataaacaatctggtcaccttcaatggcaccattgacggctggaatatccttggcggccaaggtacatgctttggagaaaagacccatgaatccgaatttagtaccggtcttcttaataatctcatctttatacagtttcctcatttccatcaaagctgacatgtcaacttcgttgaatgtggttaaggaagcagcagtgttttgagactcttttaatctttcggcaatcctcaatctcatacggttcattttgaccctggtttctgtacgtggaaatggtgtgaaagagttagaggctactgggggttcctgcgccttagagacggtcttctttggttgatcagccttttttggttctgtaacttctttctttggagcggcttctttctttggagcagcttctttctttgaagccgtttcctcacttgagttttcccttgcggcgacaccttgcgatggctccgcttgttcggtaggctctggcttagattctccagaaccctcagcaggtgcttcaccaggctcgacctgagctaactcctcaccaacagtgacagtgtcctctggtttgaaatttagcttcgtaacagtacctgatactggcgaattgacctcaatatcaattttatcggtctcaatagtggccaacagctcgtcctccttaataaaatcaccaacgtttttagtatattcctttaaagagccttcagtcagggactctgccatcggaggaacttcaatagaggtagatttaaaacgattgctagttatggagaacggattcgccgcaactgaaattttcttgccggataaatatattgaacctaaggattcgaccttgttagcttgtttgaacaaacttgtagaagcatgtctcttgacgaaagaagcagccataacatttctagccactttagattttactaaggatttggcagctgcagtacgcgtcgctctggaaagcattgtttaaataattatctgaagttgtgtctttggttgtaacaaatgtggtagtgaagtttataacaatatatctattcactgatatataccgttaaagatagctgcctaattttttatttcggatttttcttttttttacgttagatatttcctcccctgaagctcaaaaagagattatatatgaaaagtaggcctagttgagggaaaaaggatttgcatttgctgatagaccaagtgtggatccgagccctgtagtagaatggtgctaatgtagaataagaataagctttaggaaccatagattcctgcgtaatttgtggccgctttattggctcactccgggcaggaccttagttttgattggctgcaaaaaaagggttgttaatatcgtctttgacggagatgcgggtggctggaattgttttgtttattattccccaagagagaagagacaagaagtagtaatgacgatggaacaaagatcggttctaataggaccacagggttgaatagagacgagtaaagacgcaacggtcaaggctttccacgagacgttcgaatatgtcccacaacaacaggcataaaaagaataacgataaagacagctcagcagggcagtatgcaaatagcattgacaattcattaagccaggaaagcgtctcaacgaacggcgtaacaaggatggctaacttaaaggctgatgaatgcggcagtggtgatgaaggagataaaacaaagcggttttcgatttcaagtattttgagtaaaagagagacaaaagacgtgcttccggaatttgcaggcagtagttcccacaatggagtactcacggcgaattcatcaaaggatatgaactttactttggaactaagcgagaatttgttggttgagtgtaggaaattgcaatcctctaatgaagctaaaaatgagcaaatcaagtctctcaagcaaattaaagagtcattaagtgacaagattgaggagctcactaaccaaaaaaagtccttcatgaaagagttggattcaactaaagatttaaactgggatttagaatctaaattaacaaacttgagcatggaatgtaggcaattaaaagaattgaagaaaaagactgaaaaatcttggaatgatgaaaaagaaagcctgaaacttctgaaaacagatttggaaattttaacattaacaaaaaatggcatggaaaatgatcttagctctcaaaaacttcattacgataaagagattagtgaattaaaggaaaggattttagacttaaataatgaaaacgacagattacttattagtgtttctgatctaacaagtgaaattaattccttacagagcaatagaactgaaagaataaaaattcaaaagcaacttgatgacgccaaagcatctatttcttcgttaaaaagaaaagtacaaaagaagtattatcaaaaacagcatacttccgatactacagtaacatctgatcctgattctgaggggaccactagtgaagaagacatttttgatatagtgatcgaaattgaccacatgattgaaacaggcccctctgtcgaggacatttctgaagatcttgtcaagaaatactcagaaaaaaacaatatgatattgttatcgaatgattcatataaaaacttactacaaaaaagtgaaagtgcatccaaaccaaaagacgatgaattaatgaccaaagaggtggctgaaaacctgaatatgatcgcgttaccaaatgatgacaattacagcaaaaaagagttttcgttagaatctcatattaaatatttagaagcttctggctataaagttcttcctctagaggagtttgagaacctaaacgaatccctatcaaatccatcatataactatctcaaggaaaaacttcaggctttgaaaaagatacccatcgatcaaagtacgtttaacttgttaaaagagcctactattgattttttactgcctttaacatccaaaattgattgcctgataatacctaccaaagattataatgacctttttgagagtgtcaagaatccatcaattgaacaaatgaaaaaatgcctggaagcaaagaacgacttacaatcgaatatttgtaaatggctggaggagagaaacggctgtaaatggctaagtaatgatctgtatttttcaatggttaataagatagaaacaccttcgaaacaatacctgtcagataaggcaaaagaatacgaccaagtgctgattgatactaaagccttagaaggtttaaagaacccaacgatagactttctaagagaaaaagcttctgcatcagattatttattactcaaaaaagaagactacgtgagcccatcactggaatacctagttgaacatgccaaggccaccaatcaccatttactatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggcgaccaatcaccatttactatcggatagtgcatacgaagacctagtcaagtgcaaggagaatcctgatatggaattcttgaaggagaagtctgccaaactaggccatactgtggtatccaacgaggcatattctgaattgcaacgcaaatactcagaattggagaaggaagtagaacaaccatctctagcatacttagttgaacacgccaaggctaccgatcaccatttactatcggatagtgcatacgaagacctagtcaagtgcaaggagaatcctgatgtggaattcttgaaggagaagtctgctaaactaggccatactgtggtatctagcgaggaatattctgaattgcaacgcaaatactcagaattggagaaggaagtagaacaaccatcactagcatacctagtcgaacacgccaaggctaccgatcaccatttactatcggatagtgcatacgaagaactagtcaagtgcaaggagaatcctgatatggaattcttgaaggagaagtctgccaaactaggccacactgtggtatccaacgaggcatattctgaattggaaaagaaactagaacaaccatcactagcatacctagtcgaacatgccaaggctaccgatcaccatctgctatcggatagtgcatacgaagacctagtcaagtgcaaggaaaattctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatttactatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatctgctatcggatagtgcatacgaagaactagtcaagtgcaaggaaaatcctgatgtagaattcttgaaggagaagtctgctaaactaggccatactgtggtatccaacgaagcatattctgaattggaaaagaaactagaacaaccatcactggaatacctagttgaacatgccaaggccaccaatcaccatctgctatcggatagtgcatacgaagaactagtcaagtgcaaggaaaatcctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggaaaatcctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatctgctatcggatagtgcatacgaagacctagtcaagtgcaaggagaatcctgatatggaattcttgaaggagaagtctgctaaactgggccatactgtggtatccaacaaggaatattctgaattggaaaagaaactagaacaaccatcactggaatacttagtcaaacatgccgaacaaatacaatcaaaaattatatcgatctcggacttcaacaccttagctaatccatctatggaagatatggcttcaaaattgcaaaagttagaataccagattgtttcgaacgatgagtacattgcattgaaaaatacgatggaaaagccggacgttgagttactaagatccaagttgaaaggttaccatataattgatacaacaacgtacaatgagctagtcagcaatttcaattctcctacgttgaagtttattgaagagaaagccaaaagcaaaggttatagattaatagaacctaatgaataccttgacttgaataggatagccactacaccttctaaagaagagattgataacttctgcaaacaaattgggtgttacgctttggactctaaagaatatgaaagactaaaaaattctctggagaatccctccaagaaatttatagaagaaaatgccgcattacttgatcttgtgctagtggacaaaacggagtaccaagcaatgaaagataatgcaagcaacaagaaatcacttattccttcaaccaaggcacttgatttcgttacaatgcctgccccacagcttgcttctgcagagaagtcatcactacaaaaaagaactttatctgatattgaaaatgagttaaaggccttaggctacgtcgcaattcgtaaagaaaacctgccaaacctagagaaaccaattgttgacaatgcctccaaaaatgatgtcttgaacctatgttcgaaattcagtttagtaccattgtctactgaagaatatgataatatgagaaaggaacacactaaaatcttaaatattctcggtgatccatctattgatttcctgaaggaaaaatgtgaaaaatatcaaatgctcataattagtaaacatgattacgaagaaaagcaagaagccattgaaaatccaggctacgaatttattttagaaaaagcatcagcactgggatatgaattagttagcgaggttgagctggatcgcatgaaacaaatgattgattcaccagatattgactacatgcaagaaaaggctgcccgcaatgaaatggtgttgttgaggaacgaggagaaggaagcattgcaaaagaaaatagaatatccctctttaacatttttaatcgaaaaggctgctggaatgaacaaaatacttgttgaccaaatcgagtatgatgaaactataagaaaatgcaatcatcccactcggatggagctagaggaatcctgtcatcacttgaacttggttttgctcgaccaaaacgagtactcaactctaagagaacctttggaaaatcgaaatgttgaagacttaattaacaccttgagcaaactaaactacattgcaattcctaatactatctaccaagatttaattggaaagtatgagaatccaaactttgattatctaaaggattctttgaacaaaatggattacgtcgcaatctctagacaagattatgaattgatggttgctaaatacgaaaagccacaactggattatttgaaaatttcttcagagaaaatcgaccacattgtagtgcctctgtctgagtacaatttaatggttacaaattatagaaatcccagcttgagctacttaaaagagaaagccgttttgaataatcatattttaataaaagaagatgactataaaaacattttagcagtatcagaacatccgacagtgatccacctctccgaaaaggcatctttattaaataaagtcttggtagacaaggatgattttgcgaccatgtcacgctcgattgagaaaccaactatcgatttcttatccactaaggcgctatcaatggggaaaatactagttaatgaatctacgcataaaagaaacgagaaactattatctgaaccagattctgaatttttgacaatgaaagccaaggagcaagggctaattatcatttcagaaaaggaatattctgaactgcgggatcaaatagatcgtcctagcctagatgttttgaaagaaaaggccgccatttttgatagcatcatagtagaaaacatagaataccaacaactggtaaacactacaagtccctgccctcccattacttatgaagatttgaaagtatatgcccaccaattcggtatggaattatgcctccaaaaacccaacaaactttctggagctgagcgtgcagagcgcattgatgaacaatcaataaatacgaccagcagtaactcgaccacaacatcgagcatgtttacagatgcactagatgataatatcgaagagcttaatcgtgtcgaattgcagaataatgaagattatactgacataatctcgaaatcatccacagtgaaagatgctaccattttcattcccgcctatgaaaacatcaagaattctgctgaaaaattaggctacaaattagttccgttcgaaaaatcaaatatcaatctgaaaaacattgaagctccattattttcgaaggacaacgatgacactagcgttgccagtagcatagatcttgatcacttatctagaaaagcagaaaaatatggtatgaccctcatttctgatcaggaatttgaagaatatcatatactaaaagataacgcggttaatctgaatggtggcatggaagaaatgaataatcccttgtcagaaaatcaaaacttagcagcaaaaaccacaaacacagcgcaagaaggtgccttccaaaacaccgttccccacaatgatatggacaacgaagaagtcgaatatgggccggatgatccaacattcacagtaaggcaactcaagaaacccgctggcgatcgtaatttgattttgactagtagggagaaaacactgttatcaagagatgataatataatgagtcaaaatgaggcggtttatggtgacgatatatctgatagctttgtagatgaaagccaagaaatcaaaaatgatgtagacattattaaaactcaagctatgaaatatggtatgttgtgtattcctgaaagtaattttgtgggtgcatcatatgcaagtgctcaagatatgagcgatatagttgtgctttccgcgtcctattaccataatctaatgtcacctgaagacatgaaatggaactgtgttagtaatgaagaattacaagcggaagttaaaaagcgtgggctccagattgcactaacaacaaaggaagataagaaaggtcaagccacggcatccaaacatgagtatgtgtcgcataagctaaacaataaaacatctactgtgtccacaaagtctggagcaaaaaagggacttgcagaagcagcagcaacaactgcttatgaagattccgaaagtcatccacaaatagaagagcagtctcatcgtactaatcatcataagcaccataaacgtcaacagagtctgaattctaattcaacctcaaaaaccacacattcatcgaggaatacgccagcatctagacgagatatagtagcatcatttatgtcacgtgcaggatctgccagtaggacggcatctttacaaactttagcatcattgaacgaaccaagcataatacccgcgttaacccaaaccgtcattggggaatatttgtttaagtattatccacgcttgggaccttttggattcgaatcacgtcatgaaagattcttctgggttcatccatataccttaactttgtactggtccgcttctaatcccatcctagagaatcctgccaataccaaaacaaaaggtgttgccattctaggagtagaaagtgtcacagacccaaacccatatccaacaggattgtatcacaaaagtattgttgttaccacagaaactaggactattaagtttacttgtcctacaaggcaaagacacaatatttggtataattcattacgttatttacttcaaaggaacatgcaagggataagtttagaggacatcgctgatgatccaacagataatatgtattcaggaaagattttcccattgcccggcgaaaatacaaagagctccagtaaaagacttagcgcatcgagaaggtccgtatctacaaggtctctaagacatagagtaccacaaagccgatcatttggcaatttacgatagttaaaaaaactaaataactctaagtaaattaagaacaataataatcattatttcgatttttagtcctgtaaacacgtttgccaccgatgagtaacactgaaagatcagagaaagaaaaaaaaattctacctaatgaaataaataaactaaaaagattaaattaactaattctcatgttagtaggtcacgaattctttaattttgttttgtgactgaaataaatatgaaaacgataatgaataaataaataaggagaggcagcagaaatacgccaaatattcaaagggctttgttgttgaccgactaccaagtcatcctttgcaatgctttaacactagtatgtaagttcctaggcttactcaaattagtgatattatcgttgttgcttggggctagggaagtaggaagtggagtcaacgccgtatccttacttcttccatcgttagcattttgatatatttcaacgtccttatcatcaccgtgtttgaaacagcaacgcttaccgtacggacagtagcctaacttcgaccaatttatgcaaggtttagttctataattgtttgattttttcttgaatttcagttcattaagaccatgagcaaattggcatttatttccatacttacaatagcctttaatagtaaaagattcacagagctcagttttgtataaggtcttattgactaattgaggaagctgcaaaggtgcccttctacaaggttccagttttgttgttttctgaattggaagtgtgtatggaagtccagtagactgagaatccacctgagatagtttttgtaaattctccgctgtcaggggtaatgaaaatgcacttgtcgtgtaagtagggttaatctcaacttcgagtgaccttttcttacgttttttctcagttgtagcaagtgttgagatgttattattgcctgcgaaagggttattaataggtaatgtatttgtaggtctggaatctgatatgatcaagtctttaaaatctcccaacggatgataacagtttggtttggatggtaaccaaggagaaggccttggtgagtattcacttaaaatgtccgtttcatttatattatgcccctcggagctgctgctgtcatcattatcggtattttcattgagcagtgtctttatataatattcttcgatttctttaatctttgactcgtactccttgttgagatcagaaaagatcgaggacgtagtcgttgaggtcgaattggcattcggtatgtttaaatagtagctgtttggagcaacattcggcatcatggctagtgttaatccttaatagttcttattggttgagttgccgaagagactgtgatatagggttctacggctttacaatcaacttatgggtgaagaggctaaataagatgtgacttgttaagagagcaagcgcaacaagagtgcaaaaccgtcacactatgtccaatgatctacactatcaacctttgagttaatgttctctgatccagtatattagtaactgctcacactgatcaagagcgtgagagaatacgagcgaaaaagaaagaagaaaaatttgggtgccattggcacagaccctaaaagagatgtgagagaagtgggccatatatgtatatttttcccgaatgtcctaataagtaatgattggaaatcctaggtctataaactcgggtaacagaaggtggaaaatgaaaattttctattttccaattgtaaaatcagcaggcatcgttagattggctttaaagagctgagtttcccatgctgtcggttggtataatttaaggaaaagccctccctccatatccagaaggcacttgttaatactatggattataaggaagaacagaagcaggaactagaagttttagagtccatttatcctgatgaactgaggatcataaacgatgaatacccaaagattaaatttgaagtagccattaaattagagctggatacaggtgattctacttctgttttaaccaaagagcacactataatcgccgaattcaagttaccagaaaactaccctgacgaaccatgcctgatttcattggaagctcaagaagtagccctcaatgacaacgaagaagataacgaggaagatgaagacgaggttgaatatgacgaccatggtaataaagtactgaaaaagtttgaaaacctgccagatttaataagctttaaggggtacttgcctgaattaaccgtacaattagaatcgcaaatcgaaaccgatatgttattgggtatgcaaatgtgttttgcattgatttcatccataaaagaaagatgtgagcaatggtatagtgaacaattgaataagctcgagaagcagtacgagctggaagcacaagaacgtgaaaagaaggaacaggccaagttccatggtactaaagtcacaagagaatcgtacttggaatggaggtctaaatttcgccaagaactgaaactggatgaaagagaccaggtgagaaggatgaaggctcatcatgggaagctaaccggtaagcaaatgtttgaacaaggcgtggtgggcacaggcgacgagtatatggaagaggatgacgcgagtgtagatgacgtagccaagggacttgccaagaccgaaatagcaaatcaataaatacttgtgtacttaagtatttaagtattttcttctgcatggataatgacatatacaaatgtatctatataatatttttttgatattcaataaaaagaaaactgacatttgaagaaggaaatagacaagtttttagtaagatattattagtgtatatatggatacatatatctgagaatgaaaatttgttgactgtattgaatgtattgggagatgaaggggtatttggtgattagaccaacgacttggagtaagagaataagtcggaaaatgcatcatttcccttcgacttgtcctttgtagcctgaggacgggctttttgctgttttttctccgcaaagggcaatgatgtttgcgcagcagcggtggtatctgtgtctgactttgggccatcccagtcaagcaaatcatctattttactattggaagttttaggtgctgttgtgtcgggactcgtttcgctttggaagtcgccaaactcatcatcatcatcatcactattgctgttgatattattgtttttgttgtcattattaccattgtctattgttatattattcgtggtgctagtactatcgtcaagatcgattaagtcagggatgctatcttgttgttgctttcttttcctctgctgttctttatttttgatctgctctcttaatatctcccttctttgtcttctttgttcttccatatgagaacgcctgcgagtattcgaatttgcttctgtttccacaggaacattgaagttggtcacattattagcatccatttcactgtcaaagccatctgcatctgcatcaaattcatcgtcgtcgatgttatcgtaacttgcagacgttgaaatctggttggcattataaatggaggattctccttgctgtcgaattttcaaggcattcttcttattcttggctctttcctttttcaaaaattgtgagtcttccaagtattgcaagataagttctccctttttcctaatacctctctcatgaatctccattttaccatcattggagaattttaccttgaattgggcaatctccctggttaaaatatgcttatgagtgagcaaacatgatctaatctgattcagttcgtcacctgtgtcgacgttcaataataggaattcaatgactactagacattttaagaccaccctccattcggacccataattaacgtagtcctttcttgccttttcgtataggttcttgggcctggtagcgatatggtcgactaatcttttcaacgtgtattctgtcatcaagtagagcggcacttggtatctgttccttaaaaccttggcgaggtgcttcggtgtggggccccaagcatcggtatttgtagcacgacggatatctatctgataaggctcatattggactatcacgttttgggcaaaccttgcggcatttctaatatcatggatacctaaattttgaatcttttttgataatgagtccattttgtatggtgttggtatttatgcaattggaacgtttaatttgtgtatatgaatttcccttccgatttgtatattggatagaaatataattttttaaaaaaagtaaactataagcagcctggaaagataagctagaccaattcttattgataaaaaactaaagataaattcaaccgaaaactaaaatctagattgaaattaaaacaagaatgaatgaatggatcaaaggacctgaatatgaaaaaaagtgcaggagaaagaaaattttctcgctgtggaaaataagccgaaaatccgttacctagaggaaagaaagaaacgtgggaaaaacagggggcggtacccggcggcgtcaacttaacaggcataacctaggcggtagttggctagttggcaagcctggcaacatactccgatataggtaggaagagttagttataagaattgattgtcatacatacacataccttatacatatacatataatttaagagagaatagttcgtttcaatttttgctgtattgttccaggcagagcggttataattcaccggacttggcaacaacaattctagccttggtggcaccggaaggagaacccaaggactcaaccttcttaacgatgtcgtaaccgtcaacaacttcaccaaagacaacatgcttaccgtccaaccatgggcatggaacggtggtgatgaagaattgagaaccgttggtgtttggaccggcgttggccatggacaacaaacctggtctgtcgtggtgcttcttgaagttttcatctgggaatttgccaccgtagatagacttaccgccggtaccgttaccagcagtgaagtcaccaccttgcaacatgaagtctggaataactctgtggaatggagagccagcgtagccgaatcccttttcaccggtacatagagctctgaagttttctgcagtctttgggactatgtcgttgtacaacttgaaaacgacacggccaattggttggccatcagcttcgacatcaaaatagacttgggacatggtagtattagcggttgagtttggattgagttgagatattaaattcaagacaaatcttaatataacctatctagcgaaaaaggaggaacaaatgatgacgacagtggcaaaaggatagaaggctcaagagaatacgtttatatttatacagggaatcgaacagacacttgtcagcgtaagcccaaccaaagtgagaagggccacggccattaccagagacagaaatgagtggaagcgcgtggaagcccgtctagcagaggaagaaattcgagacgaggcgggacgtggcgggctgggcgccccagaaaataccgtagaggacgaggggggcggtggaaacccctaaggggcgaaaggcgggtaacatctaacagcgacgggtaagcatattgcgggtgtaaaatttttcatttcgagcttacttcaagatgatgcatatgtttaaatcacattgattatagaggtctcatcggtaaggcagagcagaactggagacgtctgaggtaagatttcgataatacaagatgatgaaaggttctagaagaacaggtaataacactgctaccacgctaaacacgcctgtggtcattcatgccacgcagctgccccaacatgtctctactgacgaggttcttcaatttctggagagctttatcgatgagaaggagaacattattgatagtactaccatgaataccatcagcggcaacgccgctgacgcggacgctgccgctgtggctaacaccagcctcaacatcgacaccaacctttccagctccatatcgcaattaaagaggattcagagagacttcaagggtctgccacccgcccaagacttttccgccgcgcccattcaggtctccacgacggagaagaaggagacaagcataggtgttagtgccaccggcggcaagaaaactacattcgccgatgagtgagacctgtagcagcagccttgcccttttacacaaaatcctacatatccattcacatacgccttctgtatactacaatatatgcatatcagttagaattctgacatctgaacgtcttcagtgcttttttttctctttctttccagatccaaatatcaccggcagcggcctcaaagtacccggttttcttttttttcacactttttttttttccaaatcatgttgtcaagcattgattgactcattttcctctgactactaccagttcaaaatgttagagaaaaatagaaaagcagaaaaaataaataaaagaaccatatttatttgttcattcactttcgagtataaaattaaatcttgtttttcttgttttcacttaagtacacatacaaattaaattgtagaaataaagcgttctaaaatggctggaaagaaaattgctggtgttttgggtgctactggttccgttggtcaacgtttcattctgttgttggcaaatcaccctcatttcgaactgaaagttcttggtgcctcttctagatcagctggcaagaaatacgttgacgctgtgaactggaagcaaaccgatttgctaccggaatctgctaccgatattattgtttccgaatgtaaatctgaattctttaaagagtgtgacatcgtcttttccggattggatgctgactatgctggcgctatcgaaaaggaattcatggaagctggtatcgccattgtttccaatgccaagaattatagaagagaacaagatgtgccattgattgttcctgttgtcaatcctgagcatttggatattgtagctcaaaagcttgacaccgccaaggctcaaggtaagccaagaccagggttcattatctgtatttccaattgttccactgcaggtttggttgcaccattgaagcctttgattgaaaaattcggtcctattgatgctttgaccactactactttgcaagcaatctcaggtgctggtttctccccaggtgtaccaggtattgatattctagacaatattattccatacattggtggtgaagaagacaagatggaatgggagaccaagaaaatcttggctccattagcagaagacaagacacacgtcaaactattgactccagaagaaatcaaagtctctgctcaatgtaacagagtcgctgtttccgatgggcacaccgaatgtatctctttgaggttcaagaacagacctgctccatccgtcgagcaagtcaagacatgcctaaaagaatacgtctgcgatgcctacaaattaggctgtcattctgctccaaagcaaactattcatgttttggaacaaccagacagacctcaaccaaggttggacaggaacagagacagcggttacggtgtttccgttggtagaatcagagaagacccattgttagatttcaaaatggttgtcctttcccacaacaccattattggtgccgctggttctggtgtcttgattgccgaaatcttactagcaagaaacttgatttaaggaaaaattgcaaagttatgtcttcatcttacttttttttcgaacgaacaaaaaatacaaaacaagtaaataagtatatgtgtatgaatatacgtataataatttgaaacgtagatctttattattagtttcttgagtttcgagaattcgtgattcaatgttcattattttttcttttcttttcttttcaatagtataataccaagcctttattatttttcttccacttcaagaaaaggtaattctctcgctgacccaagaaaaaagctaaacagagagcgtagtgatgcatacaaacaactcatttacatgggaaaaaaaaggagagaggaaagcagcagacatatctcaaagctgggatacactcacaatagcactgttggtactcatttcaggtaatactcttggaaggtatcccttaaatgaacacatcatttggctcagtagtgccttccactaatttcaattttttcaaagggcatggaaataatgataacactagtgccaatagtactgttaacaacagcaatttctttttaaatagcaatgaaacgaaaccttcgaaaaatgtcttcatggtgcactctacctctcaaaagaagtcgcagcaaccgttacaaaatctctcacactcaccttcctacacggaaaataaaccagataaaaagaaaaaatatatgataaacgatgccaagaccattcaacttgtaggtccactgatttcctctcctgataatttgggatttcagaagagatcgcacaaagcaagagaattaccaaggtttttgattaatcaagaacctcaattggagaaaagagcttttgtacaagatccctgggacaaggctaatcaagaaaaaatgatctcattggaagaatccatagatgatctcaatgaattgtatgaaacactaaaaaaaatgagaaatactgagcgatcgataatggaagaaaaagggctagtggataaagctgactcagcaaaggatctttacgatgctatagtatttcaaggtacctgtttagatatgtgtcccacattcgagagatcaagaagaaacgttgaatatactgtgtattcatatgaaaaaaatcaaccaaatgataaaaaagcttctcgaactaaagcattgaaggtcttcgcgaggccagcagcagcagcagctcctcctttaccttctgatgttaggccaccccatattttagtcaagacattggactatattgtagataacttattaacaacattgcctgaaagcgaaggattcttatgggataggatgagatccataaggcaggactttacatatcagaactattcaggacctgaggcggtagattgtaatgagcgtattgttaggatacatcttctgatcttgcatatcatggtgaaatcaaatgtggaattttcgcttcaacaagaactagaacaattgcataaatcccttatcacgttatcagaaatatacgatgacgttcgttccagcggcggaacatgcccaaatgaggctgaatttcgagcttatgctctcctgagtaaaataagagaccctcaatacgatgagaatatccaaagattaccaaaacatattttccaagataaattagttcaaatggctttatgtttcagaagggttatatctaactcagcttatactgaacgcgggtttgttaaaactgagaattgtttaaacttctacgcaaggtttttccagttaatgcaatcacccagcttgccattattaatgggattttttttgcaaatgcatctgacggatattagattttatgcgctaagagctttatcacatactttaaacaaaaagcataaaccaataccatttatttatttggaaaatatgttactctttaataatcggcaagaaataattgaattttgtaattattactcaattgaaatcataaatggggatgcagccgatttgaaaacattgcaacattattctcacaaattgtcagaaacacaacctttaaaaaaaacataccttacctgcttagaaaggagattacagaaaactacttacaagggtttaattaatggcggtgaagataatttggcttcttcggtttatgtgaaggacccaaaaaaggatagaataccttctatcgcagaccaatcttttttaatggaaaattttcaaaacaactataacgaaaagttgaaccaaaactcatccgttaaaccacagatcaatacctctccaaaaagagttgcaacgcggcccaaccactttcctttttcacaggaatctaagcaattacctcaaatatctcaatctcatactttatcaacaaatcctttattaacgccacaggttcatggagacctatcggaacagaaacaacaacaaattaaaaccgtcacagacggaggctccccatttgtttttgatcaatcagcacagaattctacggtggaagcttccaaggctcatatgatatccacgaccagcaatggtgcatatgatgagaagttgagttcagagcaagaagaaatgaggaaaaaagaagaacaacgaatagaagaagagaaaactcaattgaaaaagaagcaagaaaatgcggacaaacaagtaatcactgaacaaattgcaaatgacttagtaaaagaagtggtaaacagtagcgtgattagtattgttaagcgtgaattttcagaggctaattataggaaggacttcattgacacaatgacccgtgaactttatgacgcatttcttcatgaaaggttgtatctgatatatatggattctcgtgctgaattgaaaaggaattccactctaaaaaaaaagttctttgagaaatggcaagcatcttattctcaagcaaagaagaaccgtatattagaagaaaaaaaaagggaagaaattaaactcgtaagccaccaattaggagtaccaggttttaaaaaatctacatgtttgtttagaaccccgtataagggtaacgtaaattcatcatttatgctatcatcttcagataagaatctaatattttcacctgtaaatgacgagtttaataagtttgcgactcatttaaccaagatttcaaaactttggcggccgttagagatgcaatcaatctattatgataaccttacgaaaaagttcccctccaattctcttactccggcaaatttattcatttatgcgaaagattggacatcactctcaaaccgttggatcttaagtaagttcaatctgcaaacagcacaggattcaaaaaagttcagcaataatattatctctagcagaataatttgtattgatgatgaatatgaaccatctgattttagtgatttgcaattattgatatttaatacaggtgttacgaatccagatatattcgatttggagatgaaactgaaagatgatggtgaagaactgataaagctaatcactggtatttctctaaatacaaatatatgcttttcccttttgattatttattgggaatccgcagaaaatactttatcggaaagtaccattaaacacttactaaaattaaaccgaatatctaaaaactatagtagtgttattgaacgcattgacttaatgaatctcaccgaagaatcccctcataagtgtttagaggacaaattatctgaaatatcacattcttatgtgtacaagttgacagaaaggggaaaatatgataaaacacttcgtcagaaaaggtcattggccggcattcactcacgtagcactcaactacaaactacaaaggacattgatcaaaagatgaagaaaatgctggaaaaagagaaaaacaagtaccaacaacaaataggcgaaaggaacacctatgcgcatctagaatcgcatatagatgcatcaccaagaagcaagaaaaggaaattgccaatactcctgtcaacttctcattcgagccaatttaaaactcctctagcttctagattaaacacctctggttcgtctacttcaccacctttaccatctcatttggcgatgaaattcaggaaaaactcgagagttactagtttacataccgtattacccgttagcacaccaagccatagtaataacataccagctgcaagttttagcgggaataacaccaccgatatacagtcccaacaattaatcgaaaaccagaagagtacatctgtatatttgaataacgtttctgaaaggattctgggaaatcaagaaatatgtcaaacaccaattaatcctgttactcctgtgctagatggggccgatcaaggtaaggaggacattcctgatagtatattagagctgaagatcttgatcgattctgtcaagaagaaagtaaataatgattaaagcatttgtaatatataaacaaaagaaatgtgcattttttctatagctttaggaaaagtatttgataatcacccatttcttattactgtcggcgtgccatccttttctctaaagctcggcggaagaaaaattcaataattgtgcaaaaagtgaagccagggttgcaaatacagagttatatcaaaagacctacagagtatacatacacgttctcagggaaaagtcttctgatatattaactttacacatgcattgcctatcataatcatatactgttgaagactaatagaagcatctctaggggaaaaaaggaaacaggcgtgtgataagaggccaaaaagttataaactgcttaaaaatagggaagttccttgaggaatatgagttctgtcaaccaaatatatgacctatttcccaataagcataatatccaatttacagattctcattcacaggagcatgatacttcgtccagccttgctaagaatgatacagacggaactataagtataccaggtagtatagacactggcattttaaagagcattattgaggagcaaggttggaatgacgctgagttatatagaagttcaatacaaaatcaaagattttttttaacggataaatacactaaaaagaagcatttgactatggaggacatgcttagcccagaagaagaacaaatatatcaggaacctattcaagatttccaaacatataacaaacgtgttcaaagggaatatgagctcagggaaaggatggaagaattcttccgtcaaaacaccaaaaatgatttacatattttaaacgaggattcattaaatcagcaatattccccgttaggacctgcagattatgttctgcccctcgatagatactccagaatgaaacacattgcctcaaactttttcagaaaaaaacttggtattcctagaaaactgaaaagaagaagccattataatcccaacgcagagggccacaccaaagggaattcttctatattgagttccactactgatgtaattgataacgccagctacaggaatattgcaatagatgaaaatgttgacataacacataaagaacacgccattgacgaaataaacgagcagggtgcatcaggtagtgaatctgttgtggaaggtggatcgttattgcatgacattgaaaaggttttcaataggtccagggcaactaggaaataccatatccaacggaaattaaaagtgcgccatattcaaatgctttctatcggggcttgctttagtgtcggattatttttaacctcagggaaagccttttctattgccgggccatttggtacactacttgggtttggactcacaggtagcatcattttagccacaatgctgtcatttacagagttatccacccttattcctgtgtcttctgggttctcaggactggcttctagatttgtagaggatgctttcggatttgcattgggctggacgtattggatttcctgtatgcttgctcttcctgcccaagtttcctcaagtacattctatctcagctattataataatgtcaatatatcaaagggagtaacagcagggtttatcacgctgttttctgcatttagcattgtagtaaatttactggatgtcagcataatgggtgaaattgtatatgttgctggaataagcaaagtgataattgcaattttgatggttttcacgatgatcatcctaaatgccggacatggaaatgacattcacgaaggagtcggttttagatattgggatagctctaaatctgtccgaaatttgacctacgggctatatcgtccaacatttgacctggctgatgctggcgaaggaagcaaaaaaggaatttcaggcccaaaaggccgatttttagctacggcatcagtaatgctaatttcaacatttgcgtttagcggtgttgagatgacttttttagctagtggggaagctataaatccaaggaaaacaattccttctgctacaaaaaggacattttccattgtactgatatcttacgtttttttgattttttcggtaggcatcaacatatacagtggcgatccaagactactatcatattttcctggtatttccgaaaagaggtatgaagccattataaaaggcacaggaatggactggagacttaggactaattgtcgcggcggtattgattataggcagatttcagtaggaacaggttattctagtccttgggttgttgcattgcagaactttgggctatgtactttcgcatctgcttttaacgcaatactgatatttttcactgctacagcagggatatcctcgttatttagttgttcaagaacactatacgccatgtctgtacaacggaaggcaccgccagttttcgaaatttgcagcaagagaggtgttccttatgtttcagtgatattctcctctttattttcagtcattgcttatattgcagttgaccaaaccgcgattgaaaacttcgacgtcttggccaatgtttctagtgctagtacgtctattatatggatgggattgaatctttcctttttgcgattctattacgccctaaaacaaaggaaggatattatatcaagaaatgattcatcatacccatataaatcgccattccaaccatatctagcgatttatggtctagttggatgttcattatttgttatatttatgggatatcctaactttatacatcatttctggagtactaaagcttttttttcagcatatggtggcctgatgtttttctttatcagttacacagcttataaggttctcggaacgtcaaagattcaaagactagatcagttagatatggacagtgggaggagggaaatggacagaactgactggaccgaacatagccaatatttgggaacatatagggaaagagcgaagaagttggttacctggctgatttagggttatatgtactattattagtattattattgttagtattattattattattattattattattattattattattattattattattattattattattattattatattattattaatactaaatattgacactgctttacgcactagattgtgcgggtaactgaatattttttgaaaatgaagaaaaaaaaatttcgatgagatgaccttagtaggttaatagttattagttgcctacttatagtgaaattcatagttctaagaaaatttagaacttatacctaaaagcatcttcaggctgaggattaaaaaaggaatatgagtgaacttgaagccacaattaggcaagccaaagaagccctggctgaaaataatgccaaaaaggcgctcaaaatattgaagccgttcaaaagttcactgaaaaaagaaaacgcaaacaatgtaatactgaatgaagtgtttgccgatgcatacctggataatggacaggtagagaaagcctacccaattttagcgcgtgcttgcgaattagatcctgagggacaagttggcggaccggacaaattttttaccatgggtcaaatcatgggtggacaggatggtgtatcgataataactcgcggaataatgaacatctctaatactggaggtgaaatgttaaccaacgttcaggttgaaaagattgtaggtggactgctttctgtgattgaaatttggatgacggatttatgtatggagccaaatgcagaagagcagtgtgaggagttaatacaaaaggcgatggaactcacagagggaaaatctcctgaaacatggtctaccctgggttctatcaaaatctcgcaacaaaaatttggagaagcttatgaagcattctcacaagcctggaatttctttgagttgaaaaaacaagaaattggtagcggtataaatgaaaatggtgacacaactcagaaagctggtttacagtcagagtatgtagatcttttacaacctcttttatctttaacaaagatgtgcctcgaagtgggagcttacgaagtcgcattgaaagttattgccgcagtaagagatatagatgaggataacatagagggttattatctagagggttttacttattatttaatgagtaaattagaaattttcaagttgaacaatcccgaagtaagcctgcgtccggaaaatatatacgagtttaaccaactcattcaagaagttcctttggatttatcccacgaaccaatctcccagttaatctatgactcaagattagcgctaagttttgcattgcaagcaggtgtcaatgctgacagcaaagatgaaattgtgcaagaattattgggcggtgctaatgctttactccaagaaattggtggtcctctagatccaagtgagttaacacaaatcaagaagggtgatttagtgaatgagaatgaagacttggaagagttggacatagaggaagaatattctgactaatagtcttctaatttaacatatgcataagtacatacactgatatatatgtatatatccgtaagaaacggaaattatgacatagaacagatggaagaagattcggccaggcataccgccagggtggtgacctctttatctgtttttagtgagtattttactgtcataaccaattggaatttgtattcaatccgatatatctaattttgttttcatatctgcttcgacctccgcaacatcatcaatatcttcccattcatcgttgtcgtcgtattcatcttcgttagtgttatcaatattgtttttaggactaacgctctgtgtaatcaaatgtgtcaaatagaaaggtcgagccttattctccacctcgttctcaccatcttccggctgtatataagagacaaactcctccggtaccaaccctgtttttgatcctgactcattttctgctactagccaaccttgcccatgcttgtaactgataaatacgatgtcaccctcagccaatctcaattcattatcattttcgggttcgaaatcgtagagggcaacagcacgttggttaactatgtagtcgtctggtagtgttatactttgtcttttattgtatgtgtcttctccatttgaagaatctgaaaccatttcatcctcctcattgtctccatcaaaataaccataatggagaggattcgaatctgcgtacgcataatctttgattgatatataacctattgtggttgtttctgtatcttccattgtgtcactatttcctgcctgcactgcctccacctctctcccgttctgtaatactgcctcattgagaacacctatagtttttttgagaccagatttcaaaatattggtatctttttgtgtggtcgtttccatcgttgccatcgtagattcaataaatatgtcagtggaagttaaagtaaggtaaagttgagaaaaatacttaaaatttgttagtatctatcacgttttattggtagctgttattatgtgtgattgagcgtgttgttactgtgcactgtgttgcattgtccattacaagctacttctgaagtgaattctccatttctcgcaactggaaaaataagttggtgtgactaaaaataatagtctatctcttcacgaaaaggaaataggaatgacaaagctccaaaaggctccataaagaacttgctcagaggctggcatttgaaagggctacaagaccatgaccacatcacacagaccacagttagaagcaagaagcggtgcaaaagcggccgcttatacaccaacaggcatcgagcatgccagattactaccaggacatacaacattaaaatacaggaaatttaaagaggaggaaaatcttagagcaaactgtgcgcaagaagataggagcaacgataaatctttagaggaggcagtaatgaacgaagagaaacaggatgttgtggggagtgggaacctccaagaaacccgcagtgagaaagaccaaaaagactcgttgcaagagctgctggttactcaaaaaaataaagtggaagataaagcagagcttgaaggaaatgaacaattaaagggaggaaattcgtctaggcgatcgtggagaaagggcacggcgtttggacgccataaagtaaccaaagagacaaatattaaggaacatgcaacaaaaaaatcagcgtccggatacattaacgatatgacaaaatctgaatatcatcaagaatttctccataagcatgttagatagtacataggaacgatacataaatagtacgtttatatcttttttttttgacaagagcaagtgattttttttatcactgtcttctttaagggatcatttatcatggtgagattttcttttcaagaacctcgagaatttgctacgtttcttctctttttcgggtggttctgacttgagagaacctgctgctttgggactagaagtaccagacttaggactattgtcttggctttttaaatgaacatgagagactggttgtgccaccggtttcatttcccttagaaggaaatcaggcgggtttacttgctggcgctgatcttccttgaatttgaaaaattctctaggattttgtaaacgttccacttcatctaagaattttgttggtgttaatatctcgtcgctgccaataaagatatctctgttcttcaagtttgattgatcataagcagctttaatttcgggaattgatataccaccaataacatagtagaagaatctttgtctaggtatgtttttttttatattagagcttttcgtggtccaagctgccttgtgacggggattccttaaggatgaggaggagttagcagaggtattcgctaagcctgcttggaattcttcttcattcaataactcaattggcttgtcctttaaatatgggaagtattgttcgctcaataacaatggattcgctataacctttgaaagaatattccctacagcgggaacgaaccttgaagtgtgatagatatttggatcattcactaaagtatcatgaaaccattccttttgaaatggtttatccttcggtttgtctttgatcaatttgaaatcaattaaatcgtaatttctgaatatttttaaatattgctggaaattttcatgttcatgagtaactcctataaagttcaataatttaatgaagtctaactcgataattccacctctgaaaagagcatacgcaataatgtaacgcaatttatctaagattgtcggttccttcattgctaacgctggtaagagatcatcgataatatgctttatcttctcaccactaaaatccattccaaatccggataggttttgttcaatagcagaaatatccgctaattttctttccgcgttctctcctaggcattcatctaccagtgtcttatgcaaaatcagccttcttctttcttcatcaaaatctttcaggtgcgctacgacactcagcagatcggtagtattctttacgttcgatctatcaaccagcagagggtttttagcaatcagttccttgattcttccttgaatatattcgttggcatccataatatgctgatgtttcaaatcaatccagtcaggatcatacaaatctaccaattttgaaaccttttcctcttgctcaccagcttcattctcggcagaataatgatatatatctttttgtgtgtccacattagctaccaggtcataagccattgcttgatagctaaaatcatgtaatattggcgcaaaagggtccagtgttctatcggtgattattagaatggaacgcggtctttcagtgttttgaggagggaaatctggattattgcgagcgtatgtatctatcgctatttggaaagcgtttgcaatagaccttgttaaagaatttgcgttgactacggcgtttccattgcgggcatcttcctcttccacaggattagatacagaatatctaacaatcggatattcccccgtaataacacacaaactaactagtgagcctacaatcttcctcacgttagtaggaatcaaagccttacagttgttgttgaaaaaaacctgtaatgagtgttccatttgtaaagtttcgaagaattgagattctttgacgaaaaaccctagttcgatcggcttaaatgactccaaattttgagcaatgtaacgttttgattgaaaaaactgaaatatagggtttgttaatcctggtaaaaatctgatgtgacatcttctgtacttaggtggtcttaccatgaagtcagcatcgatacaattgatgttatatttcgttggttccaatatgtaaattgcctcgatggaggattgtccttttcttgttggggaatcaatcaaatcaacagatgtgacattatttaaaagttcttggggtgtgaggaaaagataactcaatattgtctccacagttttatcgataataagaaacttcaagttatttttcgtctcaatctgattcaaaacccctatcaaatagttcctctgtaattcaattaaatcagacatcgttccgccaaaccaagcatgtgcacactcttctactttgtcagtggattctaattattttcaaggtcttacaaagcaatgtcttactagtttcaatagggacttaaactgatcgtttaagcaaaagaaaaacaccgtgctgtgtgaccatctaccaataattgcgagaacataagacgacgccgccattcacctctctatcacttacaccatgttatagggataagtgtgtagtcgatcggctattcgatgatttttaaagagtgcctgtaataatagctgtatcgcaagtaaggaatacaagattactgatattttgatccaggaggatggacatgttagatagaaaaactaagagggctactacatccggtttagtattctgttattgggaatgcttttcccaagacgcaagcaagaggtgacacataaacatagttttcttattgtatcgttacatattcttattttacgctgctgtcattaaatatggcacttatctcagatacatttcttttaatcagcgaaaaaaatggcgaggtgaaaaaaatcgatgagatgaaaaaattttttactagtaaaggcgtattgatgatatattagcagctaaagtatagcaaggtttgtcaatttgaagcagtccgcgtgttttacaatgagcgtcattcatcctttgcagaatttactcacctctcgtgatggctcattagttttcgccatcattaagaattgtatcttaagcttcaaatatcaatcgccaaatcattgggaatttgctggaaaatggtctgatgatttcgacaaaattcaagaatcgagaaacaccactgctaaggagcaacaaggacaatccagcgaaaacgaaaacgagaacaaaaaattgaaaagtaataaaggcgattccattaaaaggacagcagccaaggtaccatctccaggtcttggcgccccaccgatatattcgtacataagaaatctgagattaacttcggatgaatcaagactaattgcgtgcgcagattctgacaagtccctcctagttttcgatgtcgacaaaacttccaaaaatgtcttaaagttgagaaaaaggttctgcttctcaaagagaccgaatgctatttctatagccgaagatgatactacagtcataatagctgacaaatttggtgatgtatattctattgatattaattctatcccggaagaaaagtttactcaagaacctattctcggtcatgtctctatgttgactgatgtacacttgattaaagactctgacggtcatcaattcataattacaagtgatagagatgagcatattaaaatttcgcattatccccaatgtttcattgtggacaaatggctctttggtcataagcattttgtttcttccatatgctgtggcaaagactatttattattaagtgcaggtggtgacgataaaatcttcgcttgggattggaaaactggtaagaacttgtctaccttcgattataatagtttgattaaaccttatttgaatgatcagcatttagcaccaccaagatttcaaaatgaaaataatgatattattgaatttgcagttagtaaaattataaagtcaaagaacctaccgtttgttgcgtttttcgtcgaagctacaaaatgcataataattctggaaatgtccgaaaaacaaaaaggggatcttgcactaaagcaaattataacttttccatataatgttatctcattatccgcccataatgatgaattccaagtcaccctagataataaggaatcatctggtgtgcaaaaaaattttgccaaattcattgaatataacttaaatgagaatagttttgtcgtgaataatgaaaaatcaaacgaatttgacagtgccatcatacaatcagtacaaggggattctaacttggtgaccaagaaagaagaaatttacccgttatacaatgtttcctcgttaagaaaacatggagaacattactcgtgaaataaaaaggtagtaagtacatctttataactaatataaaaaaagatacgtaccgatttgtgttaataatcattgttagtacatctttatacctctgtttctagctgaaggcggcgaattgaatagcagttctttttaaattggcagatacaataggattaatctcattgatacatttttgtagtctatttgtgtcgttctggaaacagttttgtaagcacgcccttaatgtggcctcggtgtccttttcaagtaaaggacccataaccttctgaaagaattccaaatccactataatttgtaatgagccatcattagaaagattaccaacataaggcttaaatgcctcaaagaggtatctggctataaaaatctgcgtttcaattaaaatcttatggatgagctgaggcccaattctaaagcactcactgtgaaccacgatcagaatcattaacgcttctataatatagtcaccaaccctgaatgaatttgatgtatacatgggccaatttatttcgtggaatttttcttcaagagtatcccttaagttgatctttaagtcagaaagatagttaccgaaaattgaagattccatcttagatagtaggctaaataattctaagtttttggaagccaaattccactcgaatgcgtcatcaaaatactgcaaaatatttgggaatgcacattctctaaaatattgtagatttgttaatgttaagatggtatgagaatttcttgggttgtccttatcctttgccgcattttttaagatcgcttccaatacagcttccatcgatataatctgttgaatttctatacctgtgagcagttgttttgacggataacttactactgaaattccgttaatgattggtaatttttcatatgcgaataatagatctctagtagttttgatactcacttcttgaaacgaggtgacaatttccggaaattgtgtcacaccatattcgaaagttagatttttactactgtcctgtgatttgcttgaaaatgtaaccgtttcatagacctgccagttctccagttgataaaagttagatatatctcttaatttcgtggaagatatggcacctacgcaacgattgattatagttgatagagtgttcctgcaaatggtgattccgttagttgtgatatttaattgcgctaactcggtagagaatttcaaaatgggctccacaattttcggtagatatcttaaacaactcaatccattacaattaggaggtataaatccataatccaaaggtgaccccgaatctttattactgcgggtaatatctccagtagaatccttcaatgatgatggtagagatgattgagaagatgtgaaaaatgatattaaattttgtgagactgaagtgatgaattcctcgccctttaacctaacctcgttaatctgttcttccttcaagatcaagcttttttggtatgattcaataatattagaatcaccgatcaaaatgttttcttttcttttttcatttataatggaattttggtaagtcccatcgaggaacttttcaatgtgttcccagaattctataaattgatcacaaattttccacaggtcgttaatatattttaagattaatagccacatttcaatgatagttggggaatcagttagtccttgagagctgggttggcaattcaaatttagatagctggttccagaaatggtgttaactttattgggttcaacggtacttttcaaaccttcactatccttgcccgtatcacttattatttggaataattgattgattttcaaataatacgacagctccacgcacccttgacttttatcttgattagtattgttttgtaatataagcctttgagaatgaatgattttactaatcatatggccagacaactcgttcagttcattctgaaagccattcattttgatggacatccatcttaggattggattttcattggatgatgaagttgtgttcttgttaccactttcactttctctttgattattattgataaagttttctaagttcaacaattttgaaaagagggacaaaattgtttcttggggttggtcaatgttaaaatttgaatttattaaactgttccaaatcagatctttatacgtgactaataaattttctatttgagtccaaattctttttataacaagagattgtgaagcatctgaactctggttgaaacggcgacggagcgtaagaccttttgaatattcgataatgaactcattgaaatcgttgttagtcaaacatctctttaaagatttgggtaggttgaagtaaaacttattcaattcaataaattttttggtggcctggtaattcaaaattttctgatagttatccattagcggtttcagtttgaaagttgttgttctaataacctcgtcgacctttttatttaagctttccacatttatttgattttcttttggtgaatcacattggtttttttcattcgttttctcgtcaaattctttgtaaatttggtctaacttgtttttaatcttaacatacttggtgaaatttttaccaaccaattgtttcaaatgtatagattggtcttgtatatcactgtccaacctgtccagtgagttatttagatcattgaaagagtcttgtttgtgcatatctctcagaaaggctttgacgttgaattgtttactgttgacaagatagttcaaccgcattgaatcatttggtagatgttgcaattctttagacatttcttgtccattcaagggatctctaatataacttaacgactcatcgtttaaatatgctctcgattccttgtcaatgctaatttgattgccatatttgaagtcttttaatatgtcgaatgacgtttcaacgccaagttcattgcttgtagcctcttcattattcaattttgaggaatcttgggcccaggaatgggtcggattaatagtcttcaactgataaaaacgaagtagttgctcgtcgccaatttgaaacctatccatggtaccaaactttttttcgctactttatttcaacagaaacttctttcctagtttagcagctttaacgcagcttatttttgttactttagttgaatagtaggagttgatacttttgttttttcaagttgaaaacagaaacgaaaaattaaagaagctgcagattcagcattcatgcctaagctaaaaagaactggcagcgaagaacagaggaaagaataactgaaactatggattttgaggaagattacgatgcggagtttgatgataatcaagaaggacaattagaaacaccttttccatcggttgcgggagccgatgatggggacaatgataatgatgactctgtcgcagaaaacatgaagaagaagcaaaagagagaggctgtagtggatgatgggagtgaaaatgcatttggtatacccgaatttacaagaaaagataagactctggaggagattctagagatgatggacagtactcctcctatcattcccgatgcagtaatagactactatttaaccaaaaacgggtttaacgtagcagatgtacgagtgaaacgacttttagcacttgctactcagaaatttgttagtgatatagctaaggatgcctacgaatattccaggatcaggtcttccgtagcggtatctaatgctaacaacagtcaggcgagagctaggcagctattgcaaggacagcaacagcctggcgtgcagcagatttcacaacaacaacatcaacagaatgagaagactacagcaagcaaagttgttctgacggtgaacgatctcagtagcgctgttgctgaatacgggctcaatataggtcgcccagacttttatcgttagtggctaacaaatggaaatgaaatatgtatatagtgtagcagtatgcaactcttttaaatacacgattcgttattagattgattagagcacttattcacgcaaatttgacacgctttttgaacatccgtttttcacgattttttactgaaggatcatgaaagattgccacataagagaacacctccgttgcaccaacacttcatcacgataaaaaaactatcgagctatcgtactacggaacaactacataagtcaaaaatggccattgattactctaagtgggataaaattgaactatcagatgattctgatgtcgaggtgcatcctaatgtggacaagaaatcgttcattaaatggaaacaacagagtatccatgaacagcgattcaaaaggaaccaagatatcaaaaatttggagacacaagtggatatgtattctcatttgaacaaacgagtggacagaattttgagtaatttacctgaaagttctcttactgatttgccagccgttaccaaattcttgaatgcaaattttgataagatggagaaaagtaaaggggaaaatgttgatcctgagattgcaacatacaatgaaatggttgaagatctttttgaacaattagcaaaagatttagacaaagagggcaaagactcgaagagcccatctctcataagggatgctattttgaaacatagggctaagatcgattcagtaactgtagaggctaagaagaaattagatgaattatacaaggagaaaaatgcacacatttcatctgaagacattcatacaggctttgatagtagctttatgaacaagcaaaaggggggggctaagccactggaagcaactccttcagaagctctttcgagcgctgcagagtctaatattcttaataaactagcaaaatcatcagttccgcaaactttcatcgattttaaagatgatcctatgaaactggccaaggaaactgaagaattcggtaaaatatccattaatgagtactcaaaatctcagaaattcttactggagcacttacctattatttcagaacaacaaaaggacgccttaatgatgaaggcctttgagtatcagttacatggtgacgataagatgactttgcaagtcattcatcaatccgaattgatggcctacattaaggaaatctacgacatgaagaaaattccatatttaaatccaatggaactatcaaatgtcattaatatgtttttcgagaaggttatcttcaacaaggacaagccaatgggtaaagagtcttttttgagatcagttcaagaaaaatttttgcacattcaaaaacgttccaaaattttacaacaagaggaaatggatgaatcgaatgctgaaggagtagagacgattcaattgaaatctctagatgattctacagaattagaagtaaacttgccagacttcaattctaaagatccagaagagatgaaaaaggttaaagttttcaaaactttaataccggaaaaaatgcaagaagccataatgaccaaaaatttggataatattaataaagtctttgaagatataccaattgaagaggctgagaaacttttggaagtgtttaatgacattgacattattggaataaaagcgatcttagaaaacgagaaagactttcaaagtttgaaagatcaatacgaacaggaccatgaagacgccactatggagaatctgtccttaaacgaccgtgatggtggcggagataaccatgaagaggtcaaacatactgccgacactgttgactagaaatttatgtagctattttactggtgcagcgtgcatctacttccttttttattgttattttcatttatacataatacaaaaaaaaaaaagaagaaaattaatgatcaataaagaaaatcgtgaaattacagcagaggttttgtacctgctttcctacgttagtacataatatcttattttttattagtgcatgtttttctcagtgtgtgtttttgtaatttgtatatactacacaaagaatcggaagggtaaaatgtgaaaaatactgggtcttttgaaatatattgaacgggctaatatatgaaatgaatatgaaaagaagaaaaaaatgtgacaagaaaaaagtggtgacaaaaaagacaaaataattattcagagatgataaacttaaagcaaaacttggtaacaaactttcattaaaacaaaatatgtattcttttttcattttcattttttttttactgtttttttgttatttcatggaactggtaaagaattcttaagattttaagctcattaataaaaacgcagcactattgtcttccccatttcttggctgctgttcatgtttctgttggtcgtgttgtaggggaggctcaatatctccattctgagagttagtaaaacttggatttgtaggtttagggctaactacgccattagtagaacttgctacgctgtctatgttaggtgctaaactgttatttctcagagaagctgcaccaattgattcccagtcttcttcgtctgtatctgagtgaggttgatgatgagaatggggaacaagttgtggcgacgattccccattcaggtgttgtgaagctactctatgtttctccttgtccgataatactatcggatttgaacttacattcatctgttcttctagcttaggggaggtggaaaccgacgtagctttagagttagggtttgtagtgacgatcaaatagtttttgtttgggaaaagtgtcgatctaatacttgattctttcgatacagacagacgagaagctcttcttgaagttggctcacttgtcgcagtaagtttctctaaatctatcttcgcctggtttgagttactgttgttatttgatggggttgtcgttgaggttgtattgggggaaaggtaggatgaatcttggtgtgtgtttagtttggaaatgaaaggtgtatgtggttttatgctcgaacggcgtctatttcttaatagcggtctaatcttttgtgctattatttcatgctcaatattctcgggagttgaatcggcgaacacaacttgagaccttctcctgccgaaactatagggatcaccatttgaagattttccaaaattattactgctgttcctcgatttgttttggtaatgtaaatgatggtcatcttcatcaaactcctcatcctcatcttccgatgctagcgcattttcatctatatatactacgtttgctgctgcaagtggagatttgctgcgtttgatattaacaggaatggtggtggaagcaacagcggtaggcggggtggtggctccatcgatattcgtgatattatgctcaactttcataggcatttcaactttgccgcctgaattagaatttgaattgttgcttttccttctttgactctcttgagaaatcaagtctttcacctttgcatttgcaaaattggtcgcttccagctccttatcaaagttggcagggtctactcttttcgcggaccattgaccccatccaattttttcaaataccactgatttttctttatcaccactttccatagcactcattataagtcgtctttgcttggaagatgataaatctttaaaacagggaatatctaggcataaggtctgtgtaatgtgtctaatggccaatggtcccatttctagtaataaagtggacagtttcccgggcgtaactctttgagcggctgctaacccagcgggtgatgatgtggagataggtttggaaaatatactagagcttgcctcggatttgaccgatatggcttgaggaggcgatacctccttttggttttctgacattattagtggtagtctgaaataatgtctttttattcaaaatttcaatttattagaaaagcacaaagcaggagcttggcgtttgtacaccgaatgattcagatgatactatactctttttccttcttttcagcggaaatttagtaacggtctttaatcgtgtttacaagtggttacaaattcacgtgctccgattggaaactggttattgacacgactcttgaaaatctcagttcgcccttttttgcgataaatttaacgtgcttctgatcaggattgccaggcaccgtttgcaatcagtgtcttttataatcgatttgtcttggatatggatggtattaccgtacctgtatctttatattatagcgtggattgcgtgagattgtgtggagatgaacatgagaaggataaagactatctgaaatagttcactcttcggttactaaggtaaggaaggcgcctctaccctctcagcgcgcacgtgcggagtgatcagcctactaccgtagggacttttgcacgttattatgggaatatcattgccaacgcaacctgattcctatacaagcagccaattcatgcaaatgactgtagtattgtatagcatgccaacattcttcatcatactatcctgaggtcctatttctacaaagatcccacaaaagggttcataattttggccgtatttcagtttctgccgtgcttgtttgagaatctggggcattccaatttgcttgacgaagatctcaagccactagcaccaataagcaacattctcactcgagaagtcgcagaaaatctctgtgactgcatttgttttagagacattctcatcattggacgggaatgttctggcgccacgataagaaatttacgaccgggaatgttgcgtactctagtttttgtcgattttgctactcactcctgctgaatttgcagtaatgttttaaagatgtggcttcgcaaccaccaacatgaaccctatggtcgtgtcttttgtttgtttcttgtaacaaatcatagcgagcagtttgaaaattattacaaaaccaaaatacgtctctagtagtgctaccatagaatttattggggcatacgtaaaacaaagtttgaatctttcttgtcatacttcgccataaattacagacagtctcgtcccctatgcttcaaaagaaataggatgcgaggggtggaggcgcttgatggaagaataatccaagtcctcaaccttttaggctaaacaatcttgggactcccgtacaaatactggatatctcaaattgctcaaaaattgtgctttattgatccaaaagttgcctgtccaaagatacatctacattgacataatggaaaacatgaaaacatacacctacgaagggcataattgtgcaagatataaatgcagcctatgtttcctgccagatggagcgtatatttccgaccgagtattactcagttgaactcattcaacgttacacaagtgaagttgattataggataatgtaggggtttataatagcgtagtcaatcaggcttatgaggaacaaaaatagtaaaagcaagcaagtatggccctatttatcttaagcgtcaagccttttatatccaagcaagcacttgcaaactttgttgttatcgctgatggcgctcctccatagcgagtattgatgcttggcataaacaacaagcctgtaagccttgccttctcattcgccttcattacaagtaaaaacgccctcatctgctatttgtttccaataaatccgtgaaaacatcggtatgttctagtgttttgatggaagcggtgctaccttattgtttgcaatatggatgactcagcttaatggttttgtgatgaacacagtaaaaaaacgttgactcctacgtgcagccgatcgtcctccacacttaaattcgttgagataaatcgtgtagtaatacactcagtcattcagtatccgtgcttgtttctttcttttcctatttgttcgcaagtgactacgtgcgcccttaattgcttacatattttaggttaagattacatcctttcttatttcggcaaaaatgaagttagtataaaatgcccatgaatgaggaccaaaatggctaaacttgataagtctttctacatagtttacatatttgttattgctatatgatgtaccttgtttatgaattaaacgaatctaaaaaggatcaccgccactaaatcaggattaatatgagtaaaagtatatcaaccttctcattttttctgtgttctacaactaagcatattttaatctgctggaccattcaacaaagccttaatcagtagaaaggtataattcaccaactctgcttagaaattgttttatagcatgtctcaactccgttggaacgctcttatctaatatttgaatcaccagagcatacatagcaggacagtatagtctaaagtcttcatcatcaaattcgtagtaaccttgtaatatttcaactatcactgaacgccaggcattgatactacgttccatggttctatcatccaaagaaacataaccctctacgacctggatgcaaatggtgatcagacgagttattaaatcagccttcttctcatcatcgttcagatacaactgaaacataatgtcaaggagaactgcagcagcactcgtttcttgtttcaacaggtttggtattttatcaactacacgagcctctactagtcttgttcttaacccataatcttcattaaagtcacgagaaaattcgtacgatttctccaacaatcttgtaattctaatggcttccttgtaagggatacagtgggcaaaatcttcgttctcgaataattcgttgagcagctctatcatcaaaagctgtaaaacacatttgacaacaatagaattcttgatgtttattctcctacgtatatcttcgttactttcgtttcgtttcatgtgcttagttttcttggggatacttagactagcgggctttggattcaattcgtcctttaccgtcggaacggaattgccattattaagcttagtttgcccattgagtgtttcaaccatgtcaccaccaacgtcttcgctggattcttcttgatgcgctctttcgaccgtctcactgatattagaatcgttctcccttctgtcgttgctatcatcatctgagtgttggctggtatcattagttgtttggtgatgagatacagatgattttcttccttgctgtaacggatcataatcgaacaattcattagcagtggttaaatcaaacaatttatcgaatacgtcacctatttgattccaatggtactcattgaatttagatacgttttgcaatatcaattgttgcaggcaggatctcccaattctagcaatagtgtcattttcttgacaaatacaggataccagcagacccaaaaatccatcgagcattctgttcaacgattcaaagtaatgcgtaaaaagggcaatcaagttccttaaggcttgaattaacgtggtcgaaagccaaacacttaaatcatcatgactattgaattggttgacttcccaatgtttggataatacaccgaaaataggaaatagtaacttcttacaaatcttttcccagaaatcatcattgaatttaccaccatatgccactagggcatcgaacatatagtttaatgcacgtgatctaacttctaagtcttcagctgtcatgatcgtatcattgaagcagaataacatagggaaccacacatcctggaatatgtctttcccacgaagtaaagcatcgttatgttttctttcttcttcagtcttattttcattgtaaaaacagatgtctgcgacgttctgagtcatctttcttagagactccaaagcatgtagagatagcttttggaatctcttatttttggtgatttctctgaagacaccaactaactcagaaaaggcatcttcttgagagaatacgttttcgaagtgatttgtcacaatatcattgctaaccagcaattgcgtctttaatacaatggattcagtgcttgagcgagccgtatattgtaaggattcaagaataggcttccagccagatttgatactttccgattttgtcaatatgaagttcctaaaacactcaataatcatttcttgaacttcagtgttgccactattttgaaccgtgtattcaaaaggttttaaaaaatcatgttgaaattcaaaacctgataattcctcaatatctaaaaatctcatagacaattgacgcagggaatcgatagcgaaaaatactactgctaagttagagtttgtagcaatcttgttgaaagcttttcccataacagcccaaagcggcgtccattctagtttgatacgatccatattgtagtaacatacatcgaccattttttgcaaggaaaacattcttggtgtggaagcattttcagatgattcaatttcttctaaagatacagcggttaaagctttgataaaatcaacgatagcattacctgataactcggaacttttggtaaatatattgtccatcaaaacgactaattcactggaggaaatgaatttagagatttcgggtgataaggtttgattatggtgtttttcttgagccaattctgtgggagttgccttcttgccccaaacatcaaagaaagatgtattattggatcttgatgattcgtaagaaactctagggtttgcaacacgagcttgtgcaacatctggaaccgtatctctgtcgatacctttggatatcaattgtagtctttccatttgagacacgaccagcaaaatgtccttccacgatccctccaagtaatttccttctgataacgcgacttcaagaagaattaccattgcattgacatttttaactttgatttcttcaaggttttgaaggttacaaaattggactaacgcacctacaaaggaggttctagcatcattgattctaaaagtagaagcaattttaattgatattttcaagccttctaaacacttattggttgtgtcaatgtcatcataatccttaaatgggggggttagagctgctaaaaaggacatccatagtgtctcgaaaattgatttaacatgctcaacgtgggaagcagcataatagacgtctgggcctcctttatttttgtttaaattcttaaagactaattccgttttagatgaaatttcttttgagacttgattatatgcctctcttgtcaaatcacgagaattaaagaagttgaaagcagattgctgttgttggacaagattggtatcacctgaaagcattgcctgatgctgttcagaaattaacttgatttcattgttagcaatttcgttgaacaaaccttccaagaagtctcttggtaaatctcttccgttgtcaataccttcgttgttttctaaaaactcttgtaaagacattttatttttgatttgtgacgaatgtaaatcagtattcaacatgatcaaagaatacgaaagcacatatgcagtatccgcctttgaaaagactccggggttttggtccacaaatctttccgcaaatttcagcatgaatctgtcaattttttgaccttctccaggcaatctgaaactttgtaaaaatgaccttaatgcgtcaacaatggacataccagtgaagtcaaactcatcaacaaatgcgtgcattatagcgatgttcttgtcgtctccttcgcctagataatccccaacagcggccatgtcgaggccttctgtttctaataaccacttggcaatggaaattggagaatcatctttcaaaaatccttttttaataagtactggaatagctttcttgggtttattgttgaaaatagcaatacattccgataaagcagttttccttagtttcaaattttcaaattgtgtggggtcgtctgcgtcaatgttttgactgctcaatgatctgctttcttcgtcttcatatgttggtttgaagtcatcattacttgtcataatagaagaccttacgtcgttactcaaagatgatctagattcttgacgagctgaagatgttgtgtttagtaataccttattagcagtgtgtgtgtttggatttaaagctttgtgagcccatgagcttaaggaacgcaaaactgacacaatgcaatttagtgacaccattttgagagcaaaatcaagtggaaaaagtaaattgacttgaccaacatcaggactagaagacaagttggaagaagtcaaaaggggcaattgtgagaaattgtaggtggacagggattttgatatttgttcatcgtagtatgatctttgagtctgagtaatttccaccctagttaaagccaatcttgtcaaataatcaacagttatttccattacatttggcattccagggttacaatcataattcaagtaaaattcaactaaagttcttgggtcgttacaaattcgttgaataacacttaaaaaatatctcttttgttgggaggtggaagtggttaattctgaaatggggaagtagatttctgttaaaaaaactggaatttccttcacgaaatctgctctcaaattagcaatcaatagccacataatttctaaagtaacctcgaaaactggagctagaggcgaggcagcattccttgataaaacaagacgtaaatattgtctaattgaatcgataaagcacacacgctcctttcctggtagaaaaatgttgtgggaaaggaatacgtcaatatgatctttgataatagagtaaatgatgtgaagagataaaagctttgacctgacggcatgtgacctcatgtcgagttctgtttccaaaggtttagcacatattttcgccatgactctaaacactaagaacgcatctttaacagctagatcttggttagttatggcgatagaatcaggctgttgagcgtccattagtctttcctcatcgtcattcaacttatccatattttccagagttaaaggagccggcgtttctgcattttcagaagcctcggaaagttctatggcggattgttgttgatgattttttgtcgataaggatactgctgaagaggtactttgtttgagatcgattttatcatacaccgaactaataatttgtgtcaaggtcgcctgtgcaataccttgattggatgggttcaacgaaaagacgaaaacgttgtagattgttctgatagcctttagcaaggaagcaccgtggcataaagaacttgaatcctcttctaaaatgcaactagataaagctctaacgatttgtagttccacacggtcatcagtgccttcaccttgaaaacagtctgaaatagtatcaattgcagcgtctataattttttgttttggaggcggcgttattccatcggcagcatcttgtcgttgatcattagaggctaaagaatcgggtggattcactaacagggtctcgtctagcgatctaaaagaaaacaattttgacaggcaatctaaagccaaactttgaactttggaggatttggtacgacagcttgcccttagtgcttcgaatactagtattgaatccacgtaatgtgggttattcgtggtttgcggatcaaattccttaaatttttgtaatgtcctttcgatagccttctgagcattcgaattctttttaatgtccttatcatttaaaattgtctccaacgtagttttcactaaaattatggttgagtttgtgttcgaaccatttgaagatagtgatatgttcctcgtatgggtagaccttggggcagtagaatcgttggtgggaacactatcttgatgagcgatagctggttcgccagcattttcctcttcttcttcttcttcttcttcttcttcttcttcttctgacccgctttcatcaccagaggagctgtttgatgtatttccatcgctttcatcagattcttcatcttctccagagctactctcagtactttcccctgagactgattcagaatcttccccgtcttcggaactggtttcggaactactgctatccacgtcctcatcatcctcgtccccattgtcttcatcttcatcttcatcttcatcttcatcttcatctccatcttcaccttcatcgtcatggcgtttgtcatttgtatcttccgtttcttcgggcgttttcattccgttggtagcgtcgttacttgtttcttttgtttctgccgtactgccagcgttttctggccctttgcatttttgatcttcaccatttgtctctttagcttcttctttaatagcattctgtggtttcacagacggattgactgaagaagcagtctctacatttgaagatatttcgccatcccctttttcagcatttactactgaattctgttcagacatcagatatagtagcacttagacttgtttcttatcttctttaatggaattcggggaaaaaatgagaaagaaacagtttaagatattactttttattggttctggagaaacttaaaagaaatcgagtatagcttagttgcagaaaatattttatatttctccggaaaatgacttcaatttctattagtctgcgtttattgaacaattggagagaagccaatgatgctttttaaagaaatgatgtaaatcccaactttgagcttcctttctcgttgctttgtttttccctcgcctcgatattataaaatttactcggcgccttgataaaaactaaacgttcaccttctttcctgtagagggaaaataacaatatgtataagccttctccgacatcaaaaaactgtaagagcttcaaaagtactaaagtgtatatcttaagagcatcgttggctccactctaacacatcaacaaaaaatatcaatgttgatttgttagagtaaaaataaaaagaggtcctacccggattcgaaccggggttgtccggatcaaaaccgaaagtgataaccactacactataggaccgacaattcatgttaaatcctccttttttaggcttttataagttactttgactagagatgactagaaatgattatattacacgcacacacaatacacacatagtgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacagaatgaggaataatcgtaatattggtatatagaaatatagattccattatggggattcctgaccctcgaggagaacttctagtatattctgtatacctaatattatagcctttatcaacaatggaatcccaacaattatctcaacattcacccatttctcatggtagcgcctgtgcttcggttacttctaaagaagtccaaacaactcaagatccgttagacatttcagcttccaaaacagaagaatgtgagaaggttttcactcaggctaattctcaacagccaacaacacctccctcagctgctgttccagagaaccatcatcatgcctctcctcaagctgctcaagtaccattgccacaaaatgggccgtacccacagcagcgaatgatgactccccaacaagccaatatttctggttggccagtatacgggcacccatctttgatgccgtatccaccttatcaaatgtcacctatgtacgctccacctggagcacaatcacagtttacacaatatccacaatatgttggaacacatttgaacaccccgtcacctgagtcaggtaattcatttcctgattcatcctcagcaaagtctaatatgacatccactaatcaacatgtcagaccaccgccaatcttaacctcacctaatgactttctaaattgggttaaaatatacatcaaatttttacaaaattcgaatctcggtgatattattccgacagcaacaagaaaagccgtacgtcagatgactgatgacgaactcaccttcttatgtcacacctttcaactatttgctctatctcaattcttacccacctgggttaaagacatcttatctgttgattatacagatatcatgaaaattctttccaaaagcattaacaaaatgcagtctgatactcaagaggtaaatgacattacgaccctagcaaatttgcattataatggaagtacacctgcagatgcatttgaagcagaagtcacaaacattcttgacagactaaaaaacaatggcattcctatcaataacaaggtagcatgccaattcattatgagaggtctatctggcgaatacaaatttttacgctacgcacgtcatcgatatatacatatgacagttgctgatctgttttcagacatacattctatgtatgaagaacaacaggaatcaaaacgtaataaatctacttataggagaagtccgagtgatgagaagaaagactctcgcacctatacgaatacaaccaaacccaaatccataactcggaattcccaaaaaccaaataattcacaatcaagaacagccagggctcataacgtatccacatctaataactttcccggccctgataacgatctcataagaggatcaactactgaaccgattcaattgaagaataaacacgaccttcaccttaggccaggaacttactgaatctacggtgaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcgcctatcgtaaaatatggagacttttactgggtatctaaaaagtacttgcttccttcaaatatctccgtacccaccatcaataatgcccatacaaatgaaagtacacgcaagtatccttatcctttcattcatcgaatgcttgcgcatgccaatgcacagacaattcgatactcacttaaaaataacaccatcacgtattttaacgaatcagatgtcgactggtctagtgctgttgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaagagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcgaattcccgagcacatggagtcgctgaacggctgaaccgtaccttattagatgactgccgtactcaactgcaatgtagtggtttaccgaaccatttatggttctctgcaatcgaattttctactattgtgagaaattcactagcttcacctaaaagcaaaaaatctcaaaattcccaatattcacatagtctaaagtaccgatagcaaccaacatatataaacagtagtattttacgaagctgaattgcaagattagtgagaggagaataaccggataatttttttggattacgttattgttaaaggctataatattaggtgaaacagaatgtcctagaagtttttttctttcatgttaaatttattgattcttgcgcttcagcttttataaaacataagaactgtttcttcacgttaacttcttgtgccacatataatgatgtactagtaatatgggtactatttggcagatgatatttgatttttattcaagacggttactgtttctacgattgatattttcattcctggatatcatcttgccagatcacttacaatttaggccgcgcctgaattgaagagtacttcaatacgtagtgtactgtccaaactctcttccaaatttttaatatttagctggggttgggtaacaagtgagcaagggaaaaagtgaacattttaagaagaacaataaaatagcaagagatggaatggtaatgcttggctctcgagaagagtagcataaaacgagacttgtttaaaacaggatatgacatacttcaattcagctttccctatcagccgctcgagcagttatataggtgtgttgccggagtaatttggcggaggccaacagtggctaggcggcaacgcctggaacacgcgcttaaaagttctggaaggttcgcgaattgagaactgctcaggggcgaatacaggggcggccttggcggcaggggggaggcctctgtgaagttagttatataagacttgctgtcatcgtttttttgatcccggcaggaactatcttttattctcatacatacggtcaagaagtataattatacataacatagggacacgttcaggcaattgtccatatcccacacaaattaagatcataccaagccgaagcaatgagtttttatcaaccatccctatctctttatgacgttttgaacgcattatccaaccaaactggccagagagggcagcaaggatatcctcgccaaccacaaaggccacagagataccatccccattatggacaagtgcacgttggcgggcatcatcctcgtcatcatccattgtatagcagatacaatggtgttcctaatacctattactaccagttccctggacaagcctattactatagtcctgaatacggttatgatgacgaggatggtgaagaagaggaccaagacgaagatatggtgggtgacagcggcactacaagacaggaagatggtggcgaggacagcaactcgagaagatatccatcatattaccattgtaatactgccaggaataataggaccaaccaacaggcaaacagtttaaacgacttattaaccgcgttaataggtgttccaccatatgaaggcactgaaccagaaattgaagcaaataccgaacaggagggcgaaaagggagaagaaaaggataagaaggataagtctgaagcacccaaagaggaagctggcgaaaccaacaaagaaaaacctttgaatcagctggaggaatcgtcgagaccaccattagccaaaaaatcttcatcgttcgctcacctacaagcgccttccccaatacctgacccgttacaagtatccaagcctgaaacgagaatggacttaccattttcaccagaagtgaatgtctatgataccgaggacacttacgtagttgttcttgcgttaccaggtgctaactctagggctttccacattgattaccatccatcttctcatgagatgctcatcaagggtaagatcgaagacagagtgggcattgatgaaaaattcttgaagatcacggaactaaaatatggtgcgtttgagagaaccgttaaattccccgtgctgccacgcattaaggacgaagaaattaaagctacttacaacaacggtctactacaaattaaggtgcctaaaattgtcaatgacactgaaaagccgaagccaaaaaagaggatcgccattgaggaaatacccgacgaagaattggagtttgaagaaaatcccaaccctacggtagaaaattgaatatcgtatctgtttatacacacatacatacatttatatttataataagcgttaaaatttcggcagaatatctgtcaaccacacaaaaatcatacaacgaatggtatatgcttcatttctttgtttcgcattagctgcgctatttgactcaaattattattttttactaagacgacgcgtcacagtgttcgagtctgtgtcatttcttttgtaattctcttaaaccacttcataaagttgtgaagttcatagcaaaattcttccgcaaaaagatgaatcttagttctcagcccaccaaaagaggtacatgctaagatcatacagaagttattgtcacttcttaccttgctcttaaatgtacattacaaccgggtattatatcttacatcatcgtataatatgatctttctttatggagaaaatttttttttcactcgaccaaagctcccattgcttctgaagagtgtagtgtatattggtacatcttctcttgaaagactccattgtactgtaacaaaaagcggtttcttcatcgacttgctcggaataacatctatatctgcccactagcaacaatgtcggattcaaaccaaggcaacaatcagcaaaactaccagcaatacagccagaacggtaaccaacaacaaggtaacaacagataccaaggttatcaagcttacaatgctcaagcccaacctgcaggtgggtactaccaaaattaccaaggttattctgggtaccaacaaggtggctatcaacagtacaatcccgacgccggttaccagcaacagtataatcctcaaggaggctatcaacagtacaatcctcaaggcggttatcagcagcaattcaatccacaaggtggccgtggaaattacaaaaacttcaactacaataacaatttgcaaggatatcaagctggtttccaaccacagtctcaaggtatgtctttgaacgactttcaaaagcaacaaaagcaggccgctcccaaaccaaagaagactttgaagcttgtctccagttccggtatcaagttggccaatgctaccaagaaggttggcacaaaacctgccgaatctgataagaaagaggaagagaagtctgctgaaaccaaagaaccaactaaagagccaacaaaggtcgaagaaccagttaaaaaggaggagaaaccagtccagactgaagaaaagacggaggaaaaatcggaacttccaaaggtagaagaccttaaaatctctgaatcaacacataataccaacaatgccaatgttaccagtgctgatgccttgatcaaggaacaggaagaagaagtggatgacgaagttgttaacgatatgtttggtggtaaagatcacgtttctttaattttcatgggtcatgttgatgccggtaaatctactatgggtggtaatctactatacttgactggctctgtggataagagaactattgagaaatatgaaagagaagccaaggatgcaggcagacaaggttggtacttgtcatgggtcatggataccaacaaagaagaaagaaatgatggtaagactatcgaagttggtaaggcctactttgaaactgaaaaaaggcgttataccatattggatgctcctggtcataaaatgtacgtttccgagatgatcggtggtgcttctcaagctgatgttggtgttttggtcatttccgccagaaagggtgagtacgaaaccggttttgagagaggtggtcaaactcgtgaacacgccctattggccaagacccaaggtgttaataagatggttgtcgtcgtaaataagatggatgacccaaccgttaactggtctaaggaacgttacgaccaatgtgtgagtaatgtcagcaatttcttgagagcaattggttacaacattaagacagacgttgtatttatgccagtatccggctacagtggtgcaaatttgaaagatcacgtagatccaaaagaatgcccatggtacaccggcccaactctgttagaatatctggatacaatgaaccacgtcgaccgtcacatcaatgctccattcatgttgcctattgccgctaagatgaaggatctaggtaccatcgttgaaggtaaaattgaatccggtcatatcaaaaagggtcaatccaccctactgatgcctaacaaaaccgctgtggaaattcaaaatatttacaacgaaactgaaaatgaagttgatatggctatgtgtggtgagcaagttaaactaagaatcaaaggtgttgaagaagaagacatttcaccaggttttgtactaacatcgccaaagaaccctatcaagagtgttaccaagtttgtagctcaaattgctattgtagaattaaaatctatcatagcagccggtttttcatgtgttatgcatgttcatacagcaattgaagaggtacatattgttaagttattgcacaaattagaaaagggtaccaaccgtaagtcaaagaaaccacctgcttttgctaagaagggtatgaaggtcatcgctgttttagaaactgaagctccagtttgtgtggaaacttaccaagattaccctcaattaggtagattcactttgagagatcaaggtaccacaatagcaattggtaaaattgttaaaattgccgagtaaatttcttgcaaacataagtaaatgcaaacacaataataccgatcataaagcattttcttctatattaaaaaacaaggtttaataaagctgttatatatatatatatatatatagacgtataattagtttagttctttttgtaccatataccataaacaaggtaaacttcacctctcaatatatctagaatttcataaaaatatctagcaaggtttcaactccttcaatcacgttttcatcataacccttccccggcgttatttcagaatgtgcaaaatctattagtgacatggaactcaaagaaccagttgtttttttgtcctttggtccttcgctgcttccctcggcatcatcatcatcatcatcatcattatcatcatcgtcgtcatcatcgtctataaaatcatctcgcataagtttgtcaacatcatttagtaattcccatcgctccgggtctccttcgtaaataaacaaaagactacttgatatcattctaacttcttcttctagcatagtattataaaacaactgcaatcttttcaaaaatgttttcttcagttgatgctttctcgcatccgacagatgaggattgttaaaataaagttcaattgcatctgaaacattttgatcggttcttgaacgaccatacaatttgtttataaagatataatcactgtctgcttcttcttcgtaatattcgagcgaaagctgattcagcacagagggatttttctgtattttcatgccacatatcctgaaacccaaagatcctgaagtcgtcgtctcactgactcttttcattctctctcttttttccaatgatgccttcgaatcatacaaagttttgcctaattttatatcaagtatattaggtttactaaatccatatagtagattttctaaaacgaggtattgcttggacttctcagactttacaggtattgaatcaagattatcagtggaatcacttaaccgctcatctatcttcagaagcgcagcatcgccactttgctcgatttttgccccttcattcaagactccaagatacgtgggcatccaagagcacaagggagcatctccatcagccgaagactttcttcgactcacatctctcacttgtatggctttgtagaattccagttcctgcggaaaggccggtttaaagatgagcaatccatcaccgtctgttagagtaccgtcgtggccagcagctttatgctctaaaaccctataattgtttaccgtatccatgtgaaaaaaatttctacttaggcacacgtatgcacatatccatgtaagctactaatggaaattgtttaactgattactggtaaaaaagggatctccaatggctttatcttattccattttgtcccaccatttgtatacagtataaagacattttggtgagatacttagttacccagcctacttctgagaaatattacccgactcgattatctaccaattggcttcgagaacgtggtttttcaccattttttttcccgcttttttttttcatccgaccgttgtggcggagagaagcttccggaagggaattcactcagattctctccagtaccacggggggcaactctgcctggaacactctcttccttcaagaacttagcaagaagtaccaattagtcccagcgggccctcagggctggtctactgccttatactctaggatgtacatcctaccacacacaacaagcctgtcacaccatgactacagatccttctgtcaaattgaagtccgccaaagactccctcgtctcctccctcttcgagttatcaaaagctgctaatcagacagcctcctctattgttgatttctacaatgccatcggcgacgatgaagaagagaagatagaggctttcaccactttgactgagtctttgcaaacattgacttctggtgtaaaccacttgcacggcatcagctcggagctggttaaccctattgatgatgataaagatgctattatcgctgctccagtcaaggctgtaagaagaaagatcgaacgtgatccaaatgctccaaagaagccactgactgttttctttgcttactctgcgtacgttcgtcaagaacttcgtgaagacagacaaaaggctggcttgccacctttatcctcaactgagattactcaagaaatctccaagaaatggaaggaattgagtgataacgaaaaagaaaaatggaagcaggcttacaacgtcgagttggagaattaccaaagagagaaatccaaatacttagaagcaaagaaaaacggtaccctaccaccagcttccttggaaaacggtccaactcatgcgccggttccaattcctttcagtttacagcacgccgctgaacctcctgtggaaaagagacctcacgatgatgatggatcttcggaaaagaagaagaagaagaagaagaaggataagaagaaggacaaatccaactcttctatttgatggacggacaaactcgttactattactctactgtctttctaaaataaatataataataaaaaaaggaataaaatatagcagcatgggcttgctttgcccatagtgtatgcacatatatatatatatatatgtatctatccctctcctcttgtaacagtatatcttccttttcattttcgttgtgtatatgtatgtatatagttctaaatttgcgattataccttttcaaacctctcaatgttgtattgtgctaaaactatgtacattttagagaaaaagaaggaagcaaaacaaatacataatatatacaggggggccgttctttttgtttttgaacatgtattaaagagtgctcaataattgatctacaatatcaaatttcttctttggtgcatcttcagggcgtttccagtgttcaggaaactcataatcccgcttctttttacgtaaactcttagctatagtatgccttgtgtcaaggggaacatcgctaaaatcgtcctccgtcaaatcttttgactccgctaacagcctttgaagaatatcatgcaaataacgtgcattttgtgatgcatgctcaaatttgtcactagacattttaaaaatatctgtagtatgatcataacgcgacctggctaatattctgaacttatgtaatgatttttcctccaggcccaattccttggttttaacgcttaatacaaccttcctcgaattgggatgctcttcgccaacataactagtgtatctataagtgaccggatgactttctggagatggtctcttgtattcctggcgatattgagctaatagcggtaactcatatgcggctaatcgattatagaacctttgttcacgatgttgggcaaccaattcctgagcttgcgatggcaattcatcaaacataaacggtctaagactgttatcgcgattcacgtttccaccttttatatcaatagcgccttgttctcctctgtgatatagctttttaatatcgttaacaggtacatttgagtactcagaagtggttaataaggcattcagttcgtctttgttaggtttatactctgaacccaatctagccattctctcccaatataactctaaaattctttgaggaggtaaacccttccatttttcgggatgcatatagagatctgctgaaaaagctggtccttctctcacagttttagcttcattaccagcatcactgttcaaacatctagacattgtcaaaacccttttctgggtgctccacaaattaccccgagagactttccataaccccaatggtactttcatcttcctaagaatagtattttagtagtgtcaaatgtttcggtaactctactgccttgttcacagatcgaaatatactcagaatcagttacagaaaaggtcccatttagcgtaatttcttagcggaactcattaaagagctccgacgtgcaacgcgataaaggttcgccgacgacaacaaaacaatggcaggcagtcattaaatgaacgccatcaaatgaaatattcgtggtagcgattacaataaggaagttggaaaaacataacaaagacggagcgacgagaagtattggacaggacatatgcctagacatggaagaagaggaaaactgccaaaaggcgagaaacttcctaaaaaggagggaggcgacaatactccgtcaaagcttttatcgtcaatgcttaaaactttagatttgaccttcgagcgtgatattggaatgctcaatggcaaaagtgttaggtccatacccaataaaaaaactttacttgaattgcaaagtcaattggatagtctcaatgaaatactgggtacaattgcccgaggtgatcaagagaccattgaagcgcttcggaaaataagagacagtaaaaatgagaagcaagcaaacgatgaaaagcaggaaacttcaaatgcagacgggcagcacgaaagttctactgctactgaagaaacgaatataattgataaaggggtacaaagcccaccaaaacctcctccttctaatgaaatctccggcacaattgagaacgatgtagaaagcatcaaacaagcggctgataatatggctaaagaagaaattaatgaagacaaagatttacaagttcatagagatcaacccagagaaaagaggccgttcgattctgaaactgaaaatagggccactgaaaatgaaaacacacagaggccagacaataagaagcaaaaaattgacgttgacaaaatggaaaacgatccaactgttaaaaatccaaaatcagaatttgtagtatcgcaaacgttacctcgagcagcagcagcactcggcttattcaatgaagagggactagaaagtacaggagaagacttcctaaaaaaaaaatacaatgtagctagttatccaacaaatgatttgaaagatctgttaccaggtgaattaccggatatggacttttcgcatcctaaaccaaccaaccaaattcaattcaatacctttctagcatttgtggaaaattttttcaaagatcttagtgatgacaacttaaagtttttgaagatgaaatatattatacccgatagcttgcaatttgacaaaacttatgaccctgaggtaaacccgtttattataccgaaactaggccctttatacacagatgtttggttcaaagatgaaaacgacaaaaattctgcctataaaaaaccttcaccatattcaaacgatgcatctactatactaccaaaaaaaagtgccaacgaacttgatgataatgctttggaatcgggcagtatatcgtgtgggcccttattatctaggctgttgagtgctgtattaaaagatgacaatgacaaatcagaattgcaatcttctaaaataatacgggatggcggactaccgagaaccggaggggaagacgatatacaatcgtttagaaacaacaacaatgatactgtagacatgacattatctcaggagaacgggcccagtgttcaaacacctgacaatgacattgatgaggaagcatctttccaagcaaaactggcagaaaataaaggcagtaatggcggtactacaagtacgttaccccaacaaattgggtggataacaaatggaattaacctggactatccaacattcgaagaacgattgaaaagagaactaaagtatgtagggatatacatgaatttgcctaaggatgagaacaaccctaactcagatgaccccgattgggtcaccggtagagaagacgacgaaataagcgcagagttaagagaattgcaaggcactttaaaacaagtgaccaagaaaaaccaaaagaggaaagcccaattgattccactagtggaaagacaactagcatggcaggaatactcatctattttagaagatttagacaaacaaatcgaccaggcttatgtcaaacgtattcgcgtacccaagaaaagaaagaagcatcatacagcagcttcaaataatgtgaacacaggaaccacgtctcaaatagcacaacaaaaggctgcaaactcaagtttaaaatcccttctggataaaaggcaaaggtggattaataagattggtccattgtttgataaacctgaaattatgaagagaatccccaatgaaagcgtattcaaggacatggaccaagaagaagatgaggatgaagccgatgtatttgcacaaaacactaataaggacgtggaactaaattaaaatatacgaactctaaggaaaaatacgtagcataataacgcatataactaacaatttggataactatccataaaaaaaaaaaaatagtcacataatacgaacattaatatccttttttgttacattttcttccatctgaaatatttggaggggcaaaaacaatgagatgacagttgaatgcatgaacttccgatcgcgggcgtataggtaaagtcaattgaagcaagtgtgacgacataagtatcgtaatttagtggttggatacattaaaaaaaacaagtggtatatatataagtagtagtagtaagaagtaagcgatgtctagggctaagagaattatgaaagaaatccaagctgtgaaggatgatcctgcagctcacattactcttgaatttgtgagtgaatctgatatccaccatttaaaaggcacatttttgggcccacctggaacaccttacgagggtggcaaatttgtcgtggatatcgaagtacctatggagtatccattcaaaccaccaaagatgcagttcgacacaaaagtataccatccaaatatatcatcagtgacaggtgccatttgtttagatattcttaagaatgcatggtcgccagtgataacactaaagtctgcattgatttcgctacaggcgctactacaatctccagagcctaacgatcctcaagatgcagaagtagcacaacactatttacgggatagagaatcttttaataagactgctgcactatggacgaggttatacgccagtgaaacttccaatggtcaaaaaggcaatgtagaggagtctgatttatatgggattgaccacgatctgattgacgagtttgaatctcaaggttttgaaaaggacaagattgtggaagtgttgagacgattaggcgtcaagtccttagaccccaatgacaacaacacagccaaccgtatcatcgaggaattgttgaagtgaatagataaaaaaaaaacgcaccaagtaagtaagtaaataaagaataaataaactatatgagtaaaacaccaagcgaggatgtttcattgtgcatccgtgttcttgatgatcacataactgtaaaagaataatacggcacgttaaatgttattttagaatatataaacaccttatgtgccataagcattgagccaatcgctgctgttttttttattccggggcaccttcggaagaacacaggcgcaatttagttatataaggagaagccctcgagcgatcaggggaccgactgcggatcgctttaaggcaaagatagaaggataaatatctgctttggaagatagtcgtatctaatttcccattctgttgttttcttgatctttcctacgctttcgactttcttcctacgcgctttataatagctatgatgttgccaagatccatgaaatttatgactggaaggagaattttccatactgccacagtaagggccttccagtctaccgctaagaagagcttaactatcccatttttgcccgtattaccccagaaaccaggtggtgttaggggcactcccaatgatgcctacgtccccccccctgagaataaattagagggctcataccactggtatatggaaaaaatctttgccttgtccgtcgttccattggctacgacggctatgctgacaaccggtccgttatccactgcagctgattctttcttttctgtcatgcttttgggatattgttacatggaatttaactcttgtatcaccgattatatttctgaaagagtttatggtgtttggcacaagtacgccatgtatatgttgggccttggttctgcggtctccctttttggaatctataaactagaaaccgagaatgatggtgttgttggtttagtaaaaagtctatgggattcttccgagaaagacaacagtcaaaagattgaagccaagaagtagataaatcaccacgaatcatttgttcggtcatgtaacatgcacatctatagcaacgacgtgtctcctatcttttgcttttaccttgttttccgccggtatattcctttgccatatttactagtatttatttattattatttattcttctatttttcttttatttatttgttacttcctaatatcgtcattattatgcctttttcatatttgatttactccaatatattctgtttgagctttgtttcccagctccgaagattttgaactaaatactctttcgtcactcgcggatttttaattatagtcagttccttttcatgacagtacacatctctacagtcaaatcttcttgaaaatttcatagatttactgactgaatccatctctgctttaaaaatattctgtagctgaattaaatggctttcgatgataccatcgtcttcaatttgacattcttctttaattaactcgtaacttaactcattatatatttcgcttaatgttaccaatgttaatttctccagttttgatcgcattaatgatgttaggattatgttttccggtagatctttaatgtttccaaaggcaaatatttcgaataattgttgttcatcgggatctttagtatttaaccattcttctttgtagtgatatttgtaaggatcttctagcgattttattgtttcttccctcattaccattctctcttatctgtactacgtaggtcatcactgttattgttttttatttctttgtttactattgtccgtaatataaatacatattaaaaaagttgatgatgagttgctcaataattttcgcattccctaagatacaacgaaccaaaggcaagataacaataatataagaaaaagcaaacgcgataagagccagggaagtcaatatatactgcacggctttatttctatatgtgtagatgcctaccattttatacaacaccaattccagtttaattaccaagtaccgaagccaaatgcctcaaatcaatataaaggctttctgtcaaaaaaaggacatacacgactgaattctaaatcgagtggagatatttgggagaaagattgtagtcatacgaaaaattctggtaatgatgtttcgtttgagagtgaatttgaaaaagattcggttgagtatctaagggatttatgtttctctatatacccaaattcattacatcagaaaatcagaagcatagaagctttgccagacctacaggtaaatacctttattgccttaattttccaaaatttcgttaagtcttggtatggtatcaaaatacccactgatgattccaagtttttaaccgaactatataacttagttcaagatttaataacatatttgaagagttccaaaatcaattaccatgcccttttactcgattatattccctgcttgctttcgtctcacttgaaagcattaaatgactcatctcaaaataacgatttagtttatgaacagtactgtaagctaactttgtatgattcgaaacgatatccaatgctattcactgaaatcatacaaagtaaaatgagcaccaaatctctactacagagaagctttttggatagctttttaaatgaacttgtgttcgggcatatttttaattcaatagcggaaccatattatcttctggagggcttgaataaaatttgcataagaataaagctaaattctgcaggaaataccagaaacgaggtgactcatggaaagcctaaatgcgatccctggttgtttgtttccaatgtaaagcacaaaatattgcaaatgaccaggcttttagcttattcaacttcaacagaagcagcaaatatgaacactgccgaaattcaagaaacagcatttctacaaagatatatttttacttttttcaccgatgattttttcaaattatctatgaggaagccattcctattctcaatatgcagaacgcttcagcattggatctctaaattaaatgcgttaaacagggtcatgtatagaacatttgacaatattgttcaaactaaaattaccagccctgtgacaattggcaacttattctcattattacgacattctttgtttcctaatgacaatatgatggggccaccaagagtattaccagtgggtgatgcttttctagagttcagagaagagtgtatttccaatttatgggatgtttgtatgacttataaacttgatcatatcctcgctatcaaaaggtctgacatagcggatcttattatctgcatatcgaagaatagggattgcaataaactgctaatttatagaattattgactgtgttattgcgcagttgccgtagacttcgtgatgtatagagtattgttgacaaatatttgatgttaccgaaatagcactctttgtagcattattaccaatttttatactatgaagtaaggtcttaggaagcaagaacattgttaacaaatagcttttatgacctaatcattagcactattcattgccaaatatgcaaatatctattccttttgcccgaacaggtaaaagtggtattgcttttatgttaaacgcgaaactgccgccacttcgcttaaaaaaaacactggctgaaaaagaacgatgcagtttagtaactaaagttttttctagctcaggcttagagttcgataacaacaagtcacattcgagtgctccacttatagcaatttttcttttgtgtattggtttgctcctgtgtgctcaggcttttcgtttgttgtgagagtattgttcttataactattcattttttgaaagaattggcggctagcaatgtcgtacccagggaaagacaagaatattcctggaagaataatagaggccctagaagacctgcctttgagttatctggttcctaaggatgggttagccgcgctagtaaatgccccaatgcgggtttctttaccttttgacaagactatctttaccagcgctgatgatggcagagatgttaatataaatgttctaggtacagctaacagcactacttcttccataaagaatgaggccgaaaaagaaaggcttgttttcaaaagacccagtaattttacgtcatcagccaattctgttgattatgtcccaactaactttttggaaggattatcaccgctagcgcagagtgttctatcaacccataaagggttgaatgattccattaacatcgagaaaaaaagtgaaatagtaagcagaccggaggcaaagcataagctcgaaagtgtgacttcgaatgctggtaacttgagtttcaacgacaattcttccaacaagaaaaccaaaacttcaacaggtgtaaccatgacacaagcgaatttagcggaacaatatttgaatgatcttaaaaatattttagatattgttggatttgaccaaaactctgctgaaattggaaatatcgagtactggctccagttgccaaataaaaaattcgttttaactacaaactgcttaaccaaattacaaatgacaattaaaaatattaccgataacccacagctatcgaactcaatcgaaataacatggcttttgagattgcttgatgtgatggtttgtaatataaagttcagtaaaagctctttaaagatgggtttagatgattctatgttacgatatattgctttgctttctacaattgtactattcaatatttttttactgggtaagaatgacagcaacttacatcgggaatcatacatcatggaaccggtgaattttttaagcgacttgatagaatctctaaaaatattaacaattgaatatggttctttgaagatagaatttgacactttccaggaggccctagaattgctaccgaaatacatacgtaacggcccttttctggatgataatgtcacggcaaagcttgtgtacatctttagcgacttgctgatgaataatgacattgaagcaactacgaatatccaatttcaaagtttttgggataatgtgaagagaatcagctctgatattttagtttcattattcggtagttttgatcaacagagaggatttattatagaagaactactatctcatatcgaaaagcttcccactaagagaatacaaaaaaaactaagaaaagttggtaaccaaaacatttatatcactgattttacctttactttaatgtcaatgttagagaatattaattgctactccttctgtaatcagatgaaggatattgcaccagagaatattgatctattaaagaacgaatacaaaaagcaagaagaatttctttttaacattgttgagcatataaatgacacaatactggaaaggtttttcaagaacccgtccgctttaaggtatgtaattgacaactttgtccaagatctattattgctaatttcctcccctcagtggcctgtaacagaaaaaatactaagctctttgttaaagagacttctaagtgtatacagcccatccatgcaagtttctgcaaacattgaaacaatatgtttacaacttatagggaatattggttctacaatttttgatattaaatgctcaactagagaccatgaagataacaacttgattaaaatgattaattaccccgaaactttgccgcatttttttaaatcatttgaagaatgcattgcatataatgaaacgatcaaatgccgtcgttctgcaacaagattcctttggaatttaaggctcggtacgatcttgatattagaagagtatacaaaggatgccaaagaacaaattataaccgttgacaatgaattgaaaaaaatattggagcagataaaagatggtggacttggacccgaattagagaacagagaagcagattttagtacgattaaattggattatttttctattttgcacgcctttgaactactgaatctatacgatccatacttgaagttgatattatcacttctagccaaggataaaatcaaactgagatcgactgctattaaatgtctctcgatgttggcttcaaaagacaaagtgatactttcaaacccaatggttaaagaaactattcaccggcgtttaaacgactcatctgcatctgtcaaggatgccattctagatttggtcagtattaattcttcatacttcgaattttatcaacaaattaacaacaactataacgatgatagcataatggtaagaaaacatgtgttaagaattaatgaaaaaatgtacgacgagacgaacgacatcgtcacgaaggtatacgtaatagcaagaatcctaatgaaaatagaagacgaggaggacaatataattgatatggctaggctgattttattaaatagatggatattaaaggtacatgaagtattggaccagcccgaaaagttgaaagaaatttcttcttcagtcctactagtaatgtcccgtgtggctataatgaatgagaaatgctcccaacttttcgacttgtttctcaacttttatctcctaaacaaagaagcgcattcaaaagaagcatacgataaaatcactcacgttctaaccattcttaccgactttttggtacaaaaaattgtcgagctcaactcagatgacacaaatgaaaagaattcgattgttgataaacaaaattttttaaaccttttggcgaagtttgctgattctactgtgtcatttttgactaaagaccacattacagcattgtatccttatatggtatcggacgaaaaatctgacttccactattatatcttgcaagtctttagatgcacttttgaaaaattggccaactttaaacagaaatttttgtatgacttagagacgacccttttgagtaggctaccaaagatgaatgtaagagagatagatgaagctatgcctcttatctggtctgttgccactcatcgtcatgatactgctagagtagctaaagcatgttcatcctgtctttcccatttacatccatatataaataaggcaaataacgaggaagctgccattgtagttgacggaaaattgcaaaggctgatatatttatccaccggttttgccaggttctgctttcctaaaccctccaatgataaaattgcatttttacaagaaggtgaaaccctgtatgaacatattaccaaatgcctacttgtactatctaaagacaaaattacacacgtaataagaagggttgctgtgaaaaatctcactaaattatgtggaaatcatccaaaactattcaattcaagacacgttctacatttactggacaaagaatttcagagcgatcagctagatattaaactagtaattctagaaagtttatatgatctttttctactggaagaaaggaagtcagtgagaaacactggcgttaatagcactttgtcttcgaactccattttgaaaaagaaattactgaaaacgaatagggtagagtttgcaaatgatggagtatgttcagcgttggctactagatttttagacaatattctccaactatgtctcctacgtgatctaaagaattctctcgtagctattcgattattaaagttgattttgaaatttggttacacaaatccctctcattcaattccaactgtaattgctttatttgcctctactagccagtatattcgtcatgtcgcctatgagttgttagaagatctttttgagaaatacgaaacgctagtattcagtagtttatctcgaggggttacaaaagctatacattattctattcatacagatgagaagtattattacaagcacgatcattttttgtctttacttgaaaaattatgtggaactggaaaaaaaaatggcccaaagttctttaaagttctgaagagaatcatgcaatcctatttagatgatatcaccgatttaacatcaacaaatagtagtgttcaaaagtccattttcgttctctgcactaacatttcgaatatcacatttgtttctcagtacgatttggtgtccctactcaaaaccattgatttaactacagatagattaaaagaggttatcatggatgaaataggtgacaatgtttcatcgctatccgtatcagaagaaaagctcagtggaataattttaatacagttaagcttacaggatttgggtacttatctactgcacttatacgggttaagggatgatgtgcttttattagatattgtagaagaatcagaattgaagaacaaacaactccctgcaaagaagccggatatcagtaagttttccgcacagttggagaatattgaacagtattcatcaaatggcaagcttcttacatattttagaaaacacgtgaaggatacgtaaatatattgcacttaaaatatacatagtattaataatcattttgcattttccatgctgatttttcacgcaggttttgagaagcaactatgaaatattgaatttcatttacaccatcgcattatattagttcaaactaaaccttttttttcttgcggacaggcaaaatattaatacctgagttagttttcattccattgtgtgtttttacaaaggtcttttcgttacaagagggcactattgctaagtttgggttgatattgttaataatagcacccacattctcagaagacctttgtgaaatctgagatgcagtgcaagatgaaattgaacctaaaggtgccttctctgaaagagttggacttatagatgcagcattgttccttaaggcattcatttcttttgatttgacagtctctgtcacagatatttcctccgctttaacattcagtttcatagacttttgtgtatcttgccttatatcccgaatgacttctggttccacctccatcgttaacgggatgacttcccttcttcttttcacagcaatttgcgttgatattcgaggagctttcttgaatttttttggatttgtgggaactttgtttttccatgaatttctctctttagtggaggttttaatcaaatacggttttcggagcggctcagctacgatagcaaaccgtgtcattcccttttgtgattgatgatcgctcagcagtactataatggaaccaccgcattgctgctctctcttctttaggcgtctctcccttatttcctcaacggttattttttcttcttcttcgtcagaggagcttgcgtaatctggaataaaagttcgatcgattcgagtatatatcttgggccaatctttgccactaaccaatttcaacaatgaatcacttgaggctggccttctagctaaattgcggcttttttttttcatagattcaaatttatgtaacattgaatcaatcagctctttagtttggtaacgtttagtctccatttcattctcgtcagtggggtcatttattttagtaaccttctgtaatgttacttcccaattcaacatacccagtctgtctgaaattaatgaaagcctgtctgcttcattttcaccatttacgatgtccgattgaatcattctattttcttgcttcaacattttcttgtggtaaggctgatacgtgctatcaggaagcaaatcatcagttggttttctaatattctggctcaattcatgatgttcaatttctagtgtcatctttgtaattgtctctctctttttcttgatctcatcatcgacattactcatgaacggcgacttcatcacaggtttctgacaacgcgtttcgtcaacatgctcatctacagtaaagcaggacttagatttccttagatgtccagcatttgggtttatcctgctgactaatcttaacttccttttagggttaatttcgtattcttctgtatcaaaatcgaatttttcaaattctccatgactatttttaatctcagacctcagcaatctctcagaagtattatttgcttcttctattgattgaaaaatacccattgatgaactctcatatgcttttaatgctgtagaaattttcggttttcctttttaatcttgctactttttgttttgagatcgctgaaatcaactcgcgggttagattttcttatttttaaaaatgtagaacgaacgattatggaaacaacaataaccaaaaagaaagggaaaacagtaccgcttctactaatctgttggatacattagacaataagctctaggaagtatggtatatcgtaacaggtcaaagagcgttttatctacacacagcaagaagagcgacgataaggcccactataaatcacgttcgaaaaagaaatcaaaaagcaggagcaagaagaggttaagaatctactggagatacatatctattgtatggatcttatggttaggattaatatcttattatgaatcagtggttgtgaagagagcaatgaagaagtgccaatggtcgacttgggaggattggcctgaaggcgctgaaagtcatagggtgggtttatttgcagacccacaaataatggacgaatattcatatcctgggaggcctcaaatagttaattattttacaagagtgattgttgaccattatcacaggagaaattggaaatatgtccagtattacttggatcctgatagcaattttttcctaggtgatctatttgatggagggagaaactgggatgataagcaatggattaaagagtacacacgattcaaccaaatattccccaagaagccactgagaagaacggtcatgtctttaccaggtaatcacgatattggttttggagacacagttgttgaatcgagtttacagagattttctagttactttggagaaacttcctcctcattagacgctggaaatcatacctttgtacttttagatacaatttcgctttctgataaaacaaatccgaatgtctcgagggttcctagacagtttttggataattttgcaatgggttcacatccgcttcctagaattcttttaactcacgttccattatggagggatccagaacagcaaacgtgcggtcagctacgtgaatccaaagaaccttttcctattcagaaagggcaccagtaccagacagttatagaaaacgatatatcacaagaaattttaacgaaaattcaaccagaaatattattttccggggatgatcatgaccattgtcagatatcacactcatatccgtttcaggggaaaactaaaaatgctcaagaaattacagtaaagtcatgtgcaatgaacatggggatcagtaggcctgctattcaattgctctccttatataatccttcagatttgacaatggtaaatgccggcggagagtatgcatcaaaaacttaccaaacagagctatgctatatgccagatccctataaggcaatcagaatgtacctatggggattattattctctgctgcctttatcgcatacatgcattttttcccaaaatcttttaataatcgcgtagcaaccataatgaacagagtatttacacgacctgatggtaacacctcagatttgccattacctacaagtatttccaaatcgaaatccaaaaaatcattgacacatagtaaatacgctgtgaatgatacgcgttcgatcaaacaatttctagttaatgcaattgtcctttttgtttctgtgatgcccatttttatttatttttatactgtagtctagacagaattactgctattctcttccaggatcaaaatgctttgaagggaaacgtctggctatttaatatatgcgaatacaccttatatacagacaatgaacaagagatataaattataccgggtgtggtattactatgctcaccaaacagtttgcataacctctactggatttgcattatgttttgtggtccaagctaaaactgcaggactgggcgtaacaccaattacttcactatacggggacaaaaaagaacacctaggtaagttgttggttcctttagttttatatcaaatttagcaagtcatgacggcaaatttctttgtaagctttgtttaaaagatggatacaaaaggacgactttcctttcaatctttcgtttttgctttttattattccatagcaatatagtgatcatagtagtgtaatttttagagtttaaaaaacacgaaagtaggatgaagtacaaaagattaacgaaaatactccattctcttaacaactcatacgtatatgaagattaaattaatatggaagataaattagacagatactacacaaatgtgctttcaaatgctgaaaaggataaacacacaactgtcgatagcgatgacaaaagtagtggcgaggaaaatttagatgaactacttaatgaattggatagagaattagacgaggatcatgaatttttgagtgcttatcggtcggagaggctacaacaaatatcagatcatttaaaacaggtcaagaagaatgttgaggatgacggatacggtagattgcagtgcattgataacgaggcagatgctatccaaatatgtacaaagactactatggtggtcatacattttgaattagaaacattcggtaagtgccagtatatgaatgaaaaactggaaaacttggcaaagaggtatctaaccacgagatttattaaagtaaacgtccaaacatgtccatttttggttaataaactgaatattaaagtacttccgtttgtagttggatacaagaatggcctagaaaaagttcgctacgtaggatttagtaaactgggaaatgaccctaatgggtttgatattaggaggctagagcaatctttagcccattcaggtgttatagaagacacattcgaaataagaaagcattcatctgtgaatacggaacgcttcgcttctacaaatcatgatagaagtgaaagtgatagtgatttagatatataactaaataaccattacctccctactaaaaatgactcgatggtcttttaagccatacgcatgagcgaaaatggttcctcctgttcaaactaaatcggttattcgagcgtaccgttgaaaatttaataaaacgttttgggggatttatagaaagttaaatacgaaatatgcgtatagtaatgtttatacatgaaactcaaaaatgcgactgtgttccttaaaataataaaagttgagtacgaataacgatgactgagaaaggtagtgtatattgtatataaaattggaccatctttgtagtaaagacaaaaaaaccaataaatgcagataaacttagcagaactaactctaaatttaactttccttggatgatttttcattgagtttttgagtaagttctaggatttgttgcttcaagtcatcattctcaaccaataaatgtgctctgtgaatttcactatcctttaaagagtccatagattttttcaattgaatacaagatctcgcgtaaccttctttaataaaattgaaattgagcagcaatttatgagtattaattattcttgccttcatttccgaaatttgacttattgtaaactcatttgtgaacttagcaggcttcgttgcagatacaatgtcttgtcttgcagaatctattttagatgttatatcagtaatcatggattctatttttaggtgggattcattagcgtcggatgaagctaacgaagatgaaggtgatagggatgcaggggataacatgggttcatttgtggttttcaaaagggattttttcttcttgatggtgggtttatctatcttatagttcttttgttctttatcaggtttatgtacgttattttggtttgtacttttatctaatgatgccttgccagtataaccctttttatgcctatcgagatcaataccaactaggctatcattagcacttctctgcatttccaaaagtgtgctcgaatcggtgttgtgttcatcgttaaataaagattccaatgttaggtgtttctgagaagcgatgtcggaatcaaaaatatcagtgcagtctaaattatccatcataacttgttcgagatcctttcccaaatctaaactctgcccatcaatctttactgtatcatcaaaatgattatttgcctgagtgagcagccgatgcaacgtatgttctatattggcatcatctgttaaatctgtattcggattggactgattcgtgttcattatcttcacgttttccctatcacaaccttagtgtaacttgaaccaacaaaatttaagatgtcaaaacttcaatcaagtattgagctcttcaatagggcactagccctctgaaatttttcattgaaaataccgtaccgcatgttttttggaaatttttcatctcatcgctaaagtggaaaaaaaaaattctagaaactgaaaaaaaagagaaaaaaaaatgacagaaaatatttgatttatatcaagatgacacgagtttgcaaaaagagaaagacacgctatagaaactattttggcaaattaatctattcacttatttttgagtttctgagtgtagttatatgcaaagaggctataaatccttatttttttgagaaaaaatgcttgagaaaaaatgcttgagaaaagatgtatttttttttattcgttagcatttttccagatatcgttgaacattgctagaatactatcaaacccgactttccccttcaccgcgttatcactaaaacgtttaacgccccagttttctactttctcactaaaggttttggtcggaacaccagacagaaactttgcatcctgcttgaaaagagtcacattcgatggatttttcggatgaggaacataacgtacggtttcgtaacacttcaaaatatgcgggaaggtcatattgcaactcctcatagttaaagatctgtcccttcgatcaacggtggagacctctcgcacgtatgctaaattagtgttccccactaaaatggacatccagtgaggggtgttctgacgtatggttatcagccgttctgtaagaagtacatcgccatgttctttgagctctcggcggagcacatcgactgcaataacgtgtgtggagatcttgtttggatatttcatccagttcgccgtggtgactttctcccatgggtaatcgaattcataagatttttgaaatgatttcattattaatatataagctcgagagatatatgactaatagaaatatttacttgaacttgtcgattagagaaaagaaaatgcgttgcttggaccgcagatcccacttattgttttcttgccaaatgtaacaagatctataggtttatgaactttcttcgaaaatctcattactttttttgataaataaacgggccccttgcggacaaagccctgaaaattgaagatttacgcagtatcacgtaaacccaaaaaaaaaaatacaatatcggttaaagtgctgttttaatttagaatatatgttttactaatctatttataatcaagtatatgtgtaatttggctttttcccttgccttgtgcttaacctagtttttttcaggtgattattttaccgggcattacctcctaatacccatcctcccatgttatccatatcatcttcgccgtataaatccagggtgacggcttttttataaacgggtttggtgactgtagaattcgagtttgagtatttcactccttcagttgttacatctgtaaagcctgcactatcattgtcatcatagagatttagattgaaattattggaatttataccagtattattgtcgttatcattatcattatagttatcattgtctgggtgattcggtactattgtgctattagtcgaatcgttatcgtcctcgcgttctttggggagagatccagacatgatttggtcttcttcctcgagatttagtaacctatgactggaattgttactatttttaatgctattcgccatcaacgcatctgtaggcgttctggacttgaagtttagtgccaaaccattcttttccatgttaccattcatcaaggtgctaaaaaggttaactgatggttgtcttctcagttcttcaaatgacttgttgatcaaattcttctcaaatagcaagttactgtttgaattatttctcattagtaatggagatgcctgttgtgtatgttgtggaattggtgaattcaagaatttttgcttcttacttgtgtcatttaataatttggaaaatgcgtttgatactgtagacatgtcattcaacgaggagtttgaactacttgcgcttgtagagggcgtagatattcgggaaataaattccggaggtatcaatccattactaatagaaggagccaagtttctgttcatcaaagatttccttttaataagcgttgcagacgatagattctttttgttgttgatagtgtctgtcccgtcaaaatcaccatcgtgcacgtagacgttagtaaaatggtttgaagaggtcgatcttttaggtgatgaagcccctgcagaatcgggttgttggctgtttggaaatttctggttgaacggcttttgcagagcagggtccattaaactcaaggacctaaacctaccccttgtttccttcgaattttttgccatagaatctattccggaggataacacgtctgtgctcgaaccagagcgggacaaaatgcttggagcgtaaaagctcaaaccttcatcgtcactctcatcgtcatcgtcatcatcgtcatcatcgtcttcatcatcatcatagttgtcttcatttccaccttcttcatcatcgtaattaaagccatattcatctgcgtatgaggttctatcctgctcttgttcccctcgttcttttgtataatcgtcataattattattgttgtacaggacaatttcctcattcttagcacggtcttgcacttcgttgatttggttgtttaactcgtcatatactagttcgtcgtttgatggtgtctttccgtaggggaagggagaaggcgatctggacatattagaactagaataggattgtgaacgggaatgtggatgcagatgcgattgtaaatgcagtgcagttcccgaaggctgcttgcgtaggttggattcctgaccaataagattgttgattgacgttgatgggatagttgtgatggattcgttcgttttgaacatatgtgccctgttggattttctgttgatagacaacgacctaattctgacggacttgtctttattggaggttaaaaccgagttttgaaaattcaacaacgacgaagagtttcttttcaaacttgtgttgctctggtcgtcgcccttatcttcgttaacagcatctgaatattcatgtagcgcttttattgattcctgggagataaggctggtgagagggtggtctgacaacaaagtcagcagtgcttttacccccgtgctattcgtgacaataactatggaatccaagacagtctggtcttgcatgctaccattgctctggtttgagccggtgaatttctcgttcaacttggtgtagtactctttgaacgggagtgacttggagttctggattgtcttagtgaaagaaccaatattctgccaattaatgatttttaaattaagcagttctgcgttcaggaaagtagaaaaccacttgagagaggtgggagaaacgttgatctggaaacataggtttagtttcttttgaacatacaagtctttgaaagaattaaacaatttttcaaccaaaaatcttatggtctccacgtaacgtaaagaccccgaagacgacaccagtacattcagatcaaacttgttttccggtgtgctgcgagagctgatcagacttttcaactcctcccaaaacttatcgttatcttccgcagtagatgtgttggaaaaactttgcgcgatcgaatttctaagccgatgcagcttaaaccgtttattcagtctggaaagcttgttatgagtcatctcatcgttgtagtagtcgatcgtagggatatctatgtaaagtaggatgttaagcttctttagcgaagggtaccggtccgccaaagacgcttgtaccactgtctgctgcatgttggagtaagtgatcagaaacagcgagtcctgtgacttcacactaacttttggtgaagtggactgggcaaagcgacgctcattaatgctcgcggctgctgcgtccgtaccgacagtgtccatcgtagtgtaggcttcccaaaatttaggatgtgattagtaatagtggttgattgcgagctccgggatgcgagggagagcgtgtatgtgtacttcaagttcgccaacttctctcttaaatagaaaaagaaaagaagaaaaaggaaacgaaaaaaaaaaaaagtagggaaaagctgagtgatgaagatccgggctgccaagattgggtttgaaacgtgtagtcagctacaaaccaaaaattaaaagaacaatagcaaagaaccttagtaggaaaacaataaaataatagacacgacacccgtagaaagatagaacgggacgaggggccggttcaacaactatcatactttcttgttcaacaacgcgattaacccaaataataaaaaagctacgagacaagaacagacgaggcaatacgagcaacgagcgcaacgagaacggtaagcatggcaacggcgcgcacacccacgccccgcaaccgcacacctcagctcaaagtaacccactttaacgtgactggacctgagctgtctgactcggtcgtttgcaaataggttaacgccgtcgcttctccctttcgtgtaccgtatatctttctttaattgcattcccttgttgtgattatcgtttcccattgcagtgagctttcattttggggaccctgggagtaggctgtttttcgatagagtgagaggtgtgggttctgcggcagaatggatacgggccgtggatcactgtttacgggagttttgctttggtggcaaaattttcgctcggtgatgtgttagtagttgttattctggtaagaaacgaacgaaagacggaaaggattatgtataacagtgtatgtgtgcagtgtgtggaaaaggtaaaggttaagggtgtggaagcagtgagaagcagaagattataatataagtagagtagaagcatgtcattgcaattgttgaatccgaaggctgaatcgttgagaagggatgcggctttgaaggttaacgtcacatctgctgagggcttacaatccgtcctagagaccaacttgggccctaagggcacgctaaagatgcttgtggatggtgctggtaacatcaagctgaccaaggacggtaaagtgttgctgaccgagatgcagatccagtcgcctacagcggtactgattgctagggcagctgccgcgcaggatgaaatcacgggcgatgggaccacgacggttgtgtgtcttgtgggtgaattgcttagacaagcgcaccgtttcattcaagagggcgtgcatccgcggatcatcactgatgggtttgagattgcgcggaaggagtccatgaaatttttggacgaattcaagatcagtaagacgaacctttccaatgatagagagttccttctgcaagtggcccggtcgtcgctgctaaccaaggtggacgctgacttgacggaggtcttgacgcccattgtaacggatgcggtgctaagcgtgtacgacgcgcaggctgacaatttggatttacacatggttgagatcatgcagatgcagcacttgtctcctaaagataccacttttattaagggtttggtattggaccacggtggtaggcatcctgacatgcccacccgtgtgaagaacgcgtatgttttgattttgaacgtatctttggaatacgagaagactgaagttaactctgggttcttttacagttctgcggaccaaagggacaagttggccgctagtgagaggaagtttgtggatgccaagttgaagaagatcatcgacttgaaaaacgaagtttgtggcatggatccagacaagggttttgttatcattaaccaaaaaggcattgaccccatgtctttagacgtgtttgccaaacacaacatcttggctttgagaagggccaagagacgtaacatggaaagattgcaattggtcactggcggtgaagctcagaactctgtggaagacttgtcgcctcagattcttgggttttctggcttggtctaccaagaaaccataggcgaggaaaaattcacatacgttacagagaacactgaccccaagtcttgcaccatcttaatcaagggctccactcattatgccctcgctcaaacaaaggatgcggtgagagatggtctcagagctgtggcaaacgttctcaaggacaaaaacatcattccaggcgctggtgcgttctacatcgccctttcgagatacctaagatctgccaacatgaacaagttgggtgccaagggtaaaacaaagacaggtattgaggcgttcgcagaagcattgctggtaattccaaagactttggtgaagaactcaggattcgacccattggacgtgctcgcaatggtggaggacgagttggatgacgctcaggattctgacgaaacgagatatgttggtgtggacttgaacataggtgattcttgcgaccctaccatcgagggtatttgggattcctaccgcgtactaagaaatgctattaccggtgctacaggtattgccagcaacttgttattatgcgatgaattgttaagggcaggtagatccactttgaaagaaacaccacagtaataaaaaataataataataataataataacaagaacacgaatactagtagtaatagtagtcagatacaaaaattctatgtaacatattttttccagtcactatcatcatcatcatattttgtatatatacatttattatataaaatatcataccaatttttgccaaagaacaccgtttccctcttcgcgttgaccacagtaattgcagaaacgacaaaaaaaaaacaaaaaaaagaagcaccattctaactcagcctttaataacctgacatgataacttataatagtcattgccagttgctaagtatctttgaccaaaaatcacaacatcatggctgtggaggaaattgcgtcccgcaaggacattagtttaagagatatgcaaatctctgccatattaaaaatgctgtttttaaataaggatttgaacaacaacgacaacatcaccaccatcacagacgatatttttaaccagcaggagatcatctggaaggtgttgatactggacatcaagagcactgctaccatatcttctgttctcagagtcaatgacctgctgaaagctggtatcaccgttcattccttgattaaacaagacagatctcccttgccagatgtccctgccatatatttcgtctcccccacaaaggaaaacattgacattatagtcaatgacttgaaaagcgacaagtattctgaattttacatcaactttacctcatctctgcccagaaacctcctggaagatttggctcaacaagtctccatcacgggtaaatctgataaaatcaaacaagtttacgaccaatacctggacttcattgtaactgaaccggaactgttctcactagaaatttcaaacgcatacttgacattgaatgacccgaaaaccacagaagaggaaatcacgggcttatgcgccaacatcgcggacggtttattcaacactgtcttaacgatcaattctatccccattataagagcagctaagggtgggcctgctgagatcatcgctgagaaactgggtacaaaattacgtgatttcgtcatcaataccaattcctcctccacttccactttgcagggaaatgattctctggaaagaggagtgttgattattttggatagaaacatagattttgcctccatgttttcacattcgtggatttatcagtgcatggtctttgatattttcaaattatcaagaaacaccgttactattccacttgaaagtaaggaaaacggaactgacaataccaccgcaaaaccattagccacgaaaaaatatgatatagagccaaacgattttttttggatggaaaactctcatttgccattcccagaagctgcagagaacgttgaagcggcattgaatacgtacaaggaggaagccgcagaaattactaggaaaactggtgttaccaacatatcagatttggacccaaactcgaataatgatacggttcaaattcaggaagtcgtaaagaaactgccagagttaacagctaagaaaaatactattgatacacatatgaatatttttgctgcattgttgtcacaattggaaagtaaaagtcttgatactttctttgaagttgaacaagaccctggaagcaccaaaacaagatctaggtttttggatatactaaaagatggtaagacaaacaatcttgaggacaaactgagatcgtttattgttctttacttgacatcaacgacaggcttaccaaaggattttgtccaaaatgtggaaaactatttcaaggaaaacgattacgatatcaatgctttaaaatatgtttataagctaagagagttcatgcaattatcaaatatgtcgttacaaaataaatctttggaagatggatccgattccgctttcaaaccaagcaacttaacattatccggtatctatggcttaactgaaggcaaattacaaggaggtgtaggaagtttaatatcaggtattaagaagttactgcctgaaaagaaaaccatcccgataacaaatgttgttgatgcgataatggaccctttaaacagctctcaaaaaaatttggagactactgacagttacctatacatcgacccaaaaattacaaggggttcccataccagaaagccaaaaagacaatcttataataagtcactagtgtttgtagttggtggcggtaactacctagaatatcaaaacctccaagaatgggcacattcccagttgcataatcccaaaaaagtcatgtatggtagcacagccattaccacaccagctgaattcttaaatgagatttctcgccttggcgcaagtaatagcagcaacaacgatgcataattggcatctagccccaatgacgatacactaatatatatatatatatatatatctatatatctgcaagaaataagcgtgtgtagtaagtaaaaggaaaaatagaaatttttgctcaaaaataacggtcccattttgatacaatgtttttggtttagtgatttgcgtaatatttatttttatttatgaaatgtgctttaggctttcttcactgttacaaataatttgcggaagtttctaaaatctttgttgaccttttggcatccaaaaacagcaatttggcttcattaacgtcattaacaacaatttccttacgattgcttgtttgtgctaggataccacatggtgccaataattgtaaagcgtaacgtaacgaagtttctgtacccatcgtggctaaaaggtccaatgcgctactttctacttgcaatctttcaacggtagctcttctctctataatggtacggatctcgtccttgtcatatggtaatgtacgaacaattaacaatctatcgatcaaatcaggtggcacaccatgtggtgatatcacatcctcagtgccacggactgtagtcatgcccctattagaagccaatacaacaacgggggcgatattagattcaagcgctttgttcaaatacgtgaatatttcaatgtctagcatattaacttcatcaatgaacaaaacacctggaataagttctgcgacaccttgatcaatatatttagcaacaactttattcacctcttgtcttaatttctcggttatttcagtcttcttaggtttgagcaactggcccatcattgatatgacatcttgaccaccttgtggtcttgcgtttgcaacatccaaatcgtgcaaggtaacatcttgtacaatttcctttttcttatgcacttcgccttttggcaatggtacgtattcctcagtttccaaatcaaattcagtagcgtatgcatcagatctgccaactcgcttaactgcaccggtgttggcctctatataaatgacatcaccaatactaaccttttctctttgaatactttcatatatcgttgggtctaatcttagtgtcttggtacccttggcagacttgagcccgacaattacatgtgagatagttttaccatatccgcccaacggattctctgcgtcttcaggggttagttctgtcacttcaccctcataaacttccttagtttctttgattcttaacccaattgctcttctaaaattttccattagggtttctgtttttttgacctccacggaatataattcgctaccaacaagaggacagaatggaacttttgggcctaactcttgtgaaatggcgagagccaatgctgtcttacctgtagaaggaccaccagctaataggatagctctacctgacatttttttagccttgattaaatctacaattacaccgcacgcttcacgagcttctatttgtccaacaaaccctccttcaaccctcttggccacaccactttcatccagacctaaacctttaatatgtgtatgtgccgcagttctcgtaactgcaccagaattactgctgtttacgccaggattttctttgacttcactgatagcgaccatatttactcaattattttaacgttcaaaatattcaggcccagaacttaacagccttcaatacgtactcttaaatgaatccatctcttcttcatcaccacgatgtatcttttgttttgccatattcttccttgaacaaaattgaaaaattttaaaaaacctctccattacccgcagagcacgtgagcaaaaaatcaattacgtttcctaaaaggggaaaacagcaactttagtgacatgttagaatatttagcaagcaaggttgtggaaaagcttaggaattacatactttagagcaacaactgtattttaaaactgtaaataatactaagcagaaccacaaaatgaagcaaaaatttgtactaccgatcaccccaccaagtacggcggaaaagaagcctcaaacagaaaaccgttgcaatgagaatttgaagcctagaagattgctaccgcaattgaaaaaaagtgtccgtaacaggaaacctagactgtcatataggcctgagttaaactctgtgtttgatctggatgcgtacgtggattcgacacacttgtccaaatcccaacgccatcatatggaccgcgacgccggttttattagctatgctctgaattatagcaaaagaatggttgtagtcagcggggcaggtatatctgttgccgctggtataccggattttagatccagtgaagggattttctctactgtgaacggcggctctgggaaagatttgtttgactacaatcgtgtgtatggcgacgaatcaatgagtttgaaatttaatcagttaatggtgtcattgttcagattatccaagaattgccaacctacaaaatttcatgaaatgctcaatgagtttgctagggatggcaggctattgagactgtacacgcagaatattgacggtttagatacacaattacctcatttatcaactaatgtgcctctggcgaagccaatacccagtacagtacaattacacggaagcataaaacacatggaatgcaataaatgtctgaatatcaaaccttttgaccctgaactgttcaaatgcgacgacaaatttgattctcggactgaaatcataccgtcatgtccacaatgtgaagaatatgaaacagttagaaaaatggcaggcttaagatctactggtgtgggcaagttgcgtccaagagtaattttatacaatgaggtccaccctgaaggtgattttatcggtgaaattgccaataatgacttaaagaaaagaattgattgtttgattattgttggaacgagtttgaagattcccggagtgaaaaatatttgcaggcagtttgcggccaaagtccatgcaaacaggggtattgtgttatatttaaacaccagtatgccgcctaagaatgtgctagactctttgaaatttgtagacctagttgtactgggagattgtcagcatgttacctcattattatagaaagtatttgtcctaccaaaaaaggttggagataaaattaatgcatttttcattagatatatatatatattcatatatattgtttaagttaccattttgtatgtttttctttgaccttactatgcaaccaatgcaggtggtggaggtatatcagggacaaggcctagttcaaacttgtttgctctgaatattttcagtgtttcctctgcgagatcggccaattctagaataccgtccttttcagaagataacccttgaacaaatctaatttttccggtggccgtattagcgttgacattagtagcattcatctgttgttgtccaaatccaaaagaggttgcgttaccattgctcttcaaacttatgttcggatctgtgtttggcattgtttgcccaaatgaagggttcgattgcgagactttgttggcatcgttttgtggtgtaattccgaatgaaaaccctttattaccaaaagaagattgaaagttgccattggtatttttattgaggttagaagcagaaccaaaggtgcccccagaacctccgctaaaaggagattgattattcgtcgttccgaatgcgctactgcccacgttattgttgttgttagctttggaggttgtagtaccaaacggcgaagaaccagcgcctgctccgctctgtagattactaaaaggtgatttgttattactattagttccaaatgtgccaaatggggatactcctgtcccactgcttgtacttgtattttgaatagtaccaaatggcgactgggtattagtagctgcgccgaaagtcggtttgccaaacgctgacgatgtagatgatgcattttgtgatgcgttttgttgcagtgaaccaaaaggagaagttgtggtcaagggcgtgtttgacgcagcaccaaatgcggagttattactattactaaccgaactagaagggatagcagttttgttcgctccaaaagctggttgaccaaatgcagagcccattgagccaggacttttaccaaaaggattacttgtcgccgccatagcaccaaaacctgttgatccaaatgacggtgctccaaatgctgacgtagtagaaggcggattaacattgatgggggcgctagaaccaaatgctggtgctccaaatgctgacggtttagccgcattactggtgttcccaaaagcgctaattgacgtattgccagtattgcctgtattggtaccaaactggggcattccaaatgctgaagtggtggttcctcctgtcattgtgtttgctgttccaaaactaggtcttccaaatgcacttcctcccatgttattggtactagcagcattatttgtgaaagggttgataccacttgtattagaaagattaggcttagcacccgacgtgaatgggttaccgaaagctgacattacagttgagtcgttgctcgggtcgaaatttaatgatagcttgatgagcttttgcgttaaagtacaacagttcagtgttatagtactttaaacattgtgcgctcatctattgattcactattttttttcaaataccttgcaccctcagtcggcgtgtttcttgatatgcagaattaatatatttctagatgtcagtatattaaggttagccctttgaaacgtattatgatgtcgttaccttcagcgtcgtggtttaggtttcatgtcttgtcctctcgcgaatacttttatttcgaagctaatttactatataaagaaggttgaaatcgcatgataagctaaacagcgtaaatagaattgccggagcaaaattcgtataagacataatttccctccaggccgtagccagattaatgctcagtacactgtaaagaattttttgtttatttttaagataagacaagatgtcattgatattattgctagatcactaacaaatggtatttattgatttttctttcgcagagcggcactttaactaggatttaatcataaaaaaaaaagtgattgacactgttattcagttctggactatcgtatagactattttcattgttaataggctcagctgttcataaaatatgtgaaaatttttcaacgattaccaagcccacgattgtctcgttggcaatattcagaatgaagttttcgtaatatggctatgtccgtgatcaatcgcctaagacaccctgacttttcaagtaaattctcaaaagctttcttccatccgtttaaataagaattacaatgttagaattacttttcctttgagaggaggaagagcgaaagtaagaatggaggtaccggtcgtaaataagcattgacgaataaatataccagtaggatcttcgtatagttatcattttaagagaataggagaagaaaaaaaatttttgtttaatatttatatactaggtatttacacgtgaaagtattgaatcaagatggggtctaaaatacaggcgtcttaatagaggaattgttatttaaaatacaacccacatctcttggtcctccttttttatcttttctaatatatgttgctgtttctactggagtaattatttttatcattactacgggagaatgagcgtctattgttgttgctgcgtctaaacggttcgtcatcgtaatctctattttggctcctattattatagtttttgttgcctctgaaagaaatttctgaatcatcatcataatcgtaggacttgttatttccatctctactactatagtctctaatttcaaacattgccttaccaattggactacggctcaaacctaatttatctaaaaaccttctggatactggaatctttaattgaggatcatttaacagtacaccataagtggaagcaatttcaggaagtatgcgcctttcagaaaacctgtattccttgatacaggatctgtaggatgagattaaacttattacaatatctgatatgtcttccggttcttcggtcactgcctctaggacctcagattttatttcttcactgggctcatatttttcttgtttggcaatgactatattttttgcatcttccaactctctaacaaatggcaattcatctttacaaatgaatagcacagaagatccttctttcccacttctggctgttctaccaattctatgaatataattagccaactcagatggaacaccaatttgcaaaacttcgtggacgtttgggaaatccataccacgggctcccacatccgtacaaaccaaaataccggattcatcttttttgaatcttttaactaaacttgttcttttattttgagtaattttaccatgaaattccaaaattggtaaatctttcttaaattcattctttaaaatactgcacaaaaaggatgtgaatttaacagttggtgcaaaaataatggctttgtaattagaatctctttcctttatttgtttctttatatgctccacagcagcaaatatactattggcaaacttttctgaaatgacgacagactgatcaattctttcatgtgcttcaggttcattcttatctactgtgtctaaaaagagacattcttttttattcatgatattgtttgccaacttttgtactttgtcgtccagagtagcagagaacaacaaagtcttgatattatcggctgatttggagttcttttcatttaaaataccagaaatagtttctaaatcatccctgaatccaatttctagcaatctgtcagcttcatctagcactttgtaatctacgaacctaaaaaatttgttggagtatttttccaaaacatcaatcaatctccctggagtggcaattacaatgtttggtctcaacttattcattttattcatagctgccctgaagtcagtaccaccaactaaagagacacaagcgtactttttcaagccataattcatatcgtggatttttttcacctctgcttcgatttgcaaggccaaatctcttgttggtgcgacaataacagcttttaccatatattgagaatcgaacttcgtatttatcaaatgctggaaaattggaatcaagaaggcaaatgtcttacctgtaccggttttagctcttgcgataacatcatggtcttcactggataatattggtttgatagtcttttgctgtacaggagttaaaccgggaaattccatcctggtaatggctttatgtatttctttatcaaggactccttcctccagtaaagagtccagcgttacttctttactattatcttcttttgggacgtgaattagtttggaaaaagtggtcttatcaaagtgcacttcatcatcgtcttctctagaccttgtccttgggcgagaattgaaacgggagtttctatacctgttactgttgttgtttctctgattcctaccaaaatttctttgatctctgtttccatcattgtataatcttcttgaaacagcccaagtaatatggttgcaattcgagagagctgctaataaatttctgcttgcaagaacaggtgtgcgaccttttatcaatatagaggtcaacatttatcagcctaacgtgcaactctggtattttcttgccactctgagacaccatagtggccatcaatacttcccttctttttataggaaaattttattctttctataatatcactacagacggagaatgaaacagatgatgattgaagcatccataagtaaagacactttgaggttgctaatttgcttttttgaaataaaacagtgccatatatcactccagcctacttgttattatcagaattgggtacggtattcatctatatattaccagttgtaaatcacgatatatcacgatacacgactctccggcgccagcgtttttcgtcagtttttctcaaggcggtataaaaaatcgatgatattcgattgaggcacttgttaacaagcatacactgttggaggcagaacaaaacaagcataactcttttgtactgtattgtactctaccgctctgtatcacgtcggcacaccaacggtttcttttggcgggtctattatatatattatatatacttttatcaagacatcgtgtgagtaagtgaggttaaagctcaaaaacctacaagcaaaggcacaaggaaatcgaaaggaccaagaaaggaaaagaaaagaaacgatacgataagtaaagacactgtggaagaattgaacaatgtcagcacctgttcctcaattagtaaatatttctcatgccttgcaagcttccactatccagcaaattcgtttggatatggtagattttaataaagattgcaaattatcttccattcaactggcaagaattgacaagtatatcgattctttgcaagcggctttgaatcagtttaccaaagataacttgcacatagaacggaaggaaaagaacgtgactgaagcagatatacagctgtattctggcttaaaatcaatgtatctagattatttgaaccagctaattaaactaaagcatgagaaacaacaccactctacaccgcccatcgctaatgatgtctccctggacttcttcgttaaccaattgcctaagttttctcccgaggaaaggaaaaattacattgacaatttaatcctgaataaaaatagccataatcgattatctaaaatggatggtctggtagatgcagtcatcaatttatgcgtcttggatacttccgttgctgaaaatgtacgatcctatatgaaattattagatacattgggtttccaaaagggttcgaatagtactggtacaaaggccaacctcaaaaagaaattggctagttcgaaagcaaagataaaggattcagaaaaagaaaaggagaaggagaaggataaatcaaaagtcaagatgaaaactaaattaaaaccttctcctttgctcaataacgatgacaaaaattcttctccatcgcctactgcatctacctcttcaatgaagaaattgaagtcgggtttattcaataaaaatgaagctaagtctacagaatctctacctacttcttccaagaaaaaactatcattttctaaatatctgaacaaggatgacgcagatatgaccaagcttgggactaaacggtcaatagatgtggatttcaaagtcaaccccgaagcatccacggtggcttctaatatcatatcttcgtcaacgtcaggatcgtcaaccacaacggtagcgactcctgcttcttcagaagagcccttaaaaaaaaaaaccaaaatatccgtgcaagactctaatgtacaatcgattttgagaaatggtaaaccgaaaaaagcacgcataagtagcatcaaatttttggatgattcccaactaataaaagtttacggtgacgatctaccgaaccaagggctacaagtttctcctactcaattgaaaaaaattctgaaaccattcaaggagggggaaccgaaggaaattatattgttcgaggatatgtcaatcaaattaaaacctcttgatttgatgtttctgaagaacacaaacagtgatgactatatggatatatccgagactaaaggtggcccaatacattgtgaaacaaggaccccgttgatctatagaaaaaatttcaatcatttcaacccggacttgaataaaaggccgccaagagaacccatagaattcgacttaaatggaaatacgaactcaaccccgactatagcaaaggctttcggtaaaaatagtttattactaaggaaggacagaggtggtttgccatacaagcatgtccccatagtaaaaagaaataaatatcctccaagaccagtacactaagctatgacatgctgatacataaacatgtagtatatatactcattttatataatgtaattataagatatcaaccttataccgctgaagactttttattttgaagttttttcatcagtaatctggacatgacgatgctactggcacttacggccccaaaaggtgggaaatactccaaaacagttcttaatttactaggttggattttttttacaacactttcaatctgttcgtataagtcaaccaatgtgctgttattttgtaggatatagtcagatcttgccatcctttcttcagtgctcatttgactatttagcctgttttttgcatcttcttcactaagttcaggatttcttgtcattaatctttctagttgcaattcttgcgtacaaattacgcttacagtcactccgcatattgaatccagatttccttcaaataagagtggcacatccaatacacacattctatatcccttcaagtaatagtagccaatttctttgaacattgcatacctgattgcaggatgtgttatcccattcaaggcttgcaaatcttctttatgactaaaaacccatttccctagggcttcacgatttaaatgcccatcctccaataataaattcggtattttgtccttgaagtataacacaatttgatcataagcattctgtcctggttcgaccacttgtctagcaatcttgtccgcatcaacaatgggtagtttgtatttgtctctgagtcttctcgacactgtgctcttaccacaagcgatcccacctgtcaatcccactaccagcatattttaattgtggctatctgacaactttcactgagcttttaatttggaccgttattattgtgccatgtattctccccatccccattctaggtaaaacaagggtaagaacaaaaatttaaaaaaaaaaaaatagaaaaaacctttgcatatatttgggtctgcctaattcatctaaagcatatttcaattacaaccacgcaaaggattaaaaaaatccagaatacgataatgtcaagctcaatacctagagtttactctctagggaactcagccatgacgtacttactagcattgagaattgcacaactcccgagtcaaccaaaggttccatcagttgttcttcttttaaacgaccagaagaaactgaatagattcctcaataatgactctaaaattattgttaaatcgagtaacaacaataaagaaacttatcatagacagtttatggcatcttgtgtcccgcccattctaagcaatggtgaaattgcaccaattgaaaatttaattgtctcagatccctcttcgaaatttatcactgcccaactttctaaatacaataaatctttgagacccgaaaccaacattctgtttttgaatccaagcttaaatctattggaacatttgcatagatatcgatggcgctttgatgaggcaagaccaaacttgttcatgggctttacaacaccagttgacgttgggaccatacatcaagaatttcaactgtctctcaaagtgaaaggaaggatacaatttcatattgcaaagattgatggttttcctcgaatgagtagtactggtaaaagtgcgagtctttctctaagaggtgacaggcagaaaaatgaaaaagaaaataatgcgttttataagttgtttagagaaatttccaggctacgatctggaataggttccgatctagttagttttgatctgcatgttcatggtttccaggatttgttcttcactgaactggagaaattgatattggagagttgtaccgagccattattggcagtatatgattgcgtatataaaaaggaacttttgaaaatccccggagcacaagatataataaaaaagttgattagtgagcagctgtcaattatcgatcgatcctacccgtcactaaacaccaacccaaactattctgtaatctttgacaaggagagaatatttagcttggtgatgagagatctagaagttaatgggcacaagcgcgctaagttggcccaatctttaaatcaattgaatcaaacgaacattaatgaacttaacggattttttgtttctcttggtaagtacaaaaaatgtaactgcaagtggaatgatatacttctgactttaataaaagggaaacagtttattactaagcaaaaagcactagattatcattacctgtgaagaaatttcatgtatatacaatagatattcctaaattttcatatatgaatggctgctgcgcacatgtacttgcgaagagaagcatgggcactggcacttccgaatttaaagttatttcttggactttacaaatacctatgattgcaggtcttgtaagtgttgtgtaagtatttttatataccctttgtatatggtaattaagttttgtaagcagaggttattctcaagattagatactttttctgtcaactcgctaagcgtctttgtatattttgcagttaaggagaccaataattcttttaaaactgaagagatttttggcttgaagtaatcttctgatatgtaaccttcaatgaattttcgaaccctcctttcatccctcgtcacataatagttcaatgctacgaatatcctataactgatatcagtctcattgatagtgtaatctccccaataatcatgttccaatagaaacgtttttacctcctttttgtcgtcgtctattagttcaataatttcgtcagatatgtctaagtagttccatttgtttccgtctaccacaaatccatactcgttcagtaaaaaatcatttgagtgtgcaccataattcaaaaagagctcctcgttaatgttgtcatagaggtgatcgccgcatctaatggtaaattgtccaattccaatgatgttttctccttctgacctcaactgaggacttaactgaggatagcagtgcaaatccgactcacaaatgtggttcatgaaatcgacatacggcactaaagtgaaattgcttggggagtcctctattttcaacggaatcttcgcataaagacatcttgagtttataataaaataaacatgtacaaaaagggagaataactcatcactagtaaatttatcagaatttttcgtacagcttaaggagccgtaaatttcattccatttcaaaaccacctctgaaatggtttcccaatcttctctgacaaggccactaattcttgccatatgctttcgtgaggcagcagggagatattcaatcagtgaatggtaacgtgaattgggatcacagttccaaatggctgggattgatcgcagctcctccattgagggccatacatcaaagaatggtttccaatctgagtagatttcattgtgagtccattttggcaatagaaaattttcaaccaatatataaaatgataccaattgaaatgatgataaacttaacaaaaactctttcgataattcggaatataatccatatctaggatcggcccaggctttattttccgcttcaataatattgtcctcataattgattggctttctatcgattgtgataccaggaatattcagctctttattaaactttgaaatatgatagaggatagtgtgaaaatttagttgcttcgagctcggtactgatacaatgatatcgttttttcttatcgaaccgtgactgaggacgatccctctgccagtttctggcgattcacagatgctgatgtttggtgctatataaaacttatctgattttttcagccatgttagcaagacatcaacctttccttccattcgcaatttactatgtaacttttttgtagatatttattcaaaatctgtatcttcgacaatcttgagactataggtgatgagtagacgcatccagttttagcttgagttcccgaatttttttttaattttacttaatcaagaaatcttgaaaaaatgaaaaaaaagagtgtggatcagaattgcaaaacaatattcaaagtatatggaatatgtgcttatttataatatatggtttttctcatttctacaggacaagccctgtttttgctttgtagattatgcttgtagtatttttcttctttcgagttattgtggcaattgcttaacggccgtcgcaactaaaccgaatgaaatggcaactactccaaagagcattcccttactaactcttgttctcttgccttcgacgactcctagttcttcagtgcttattaatgtatcttcggtatcctttttttcttctcttgaatcattttgttttactttagcgttattgtcattgttaataccaccattaaaattgctttgtgttaaaactaaattttttcccctctcttcttctatttgaaggttcagctctcttaattcactttcgagctcctgtagcttttcatggttttgtttttccttcaagctacatgcagattttactttattattttgttgtttgatttcttttaattgatcttccgattctttgagtagcgcatcattattttctgatagagttttttgtaaagccgtgctcagtttcagtaaatgcttttcattcatatcaatcatgtgcttattgatgaaatcaaggtttatcgtatagttttgcataaagttttgcatggaatgtaatttttccagctcttgtttttctaaggacagctcagtagtcaaagtttttatcatatttatcaaatttatgcttgtacctgctgaattgttgataaaaattccactgagaacctcagtttctggacctaaaatatcatcatctaattctgagttattaatatctccaaacatagctgcctcaaaggctgccctttgagccgttgttgcagatgttacaccagcttcggtataattttcctttaaatgagatcgtattggaatgtgttgattatgatgacctctgtctatctttattccgtttatattagtggagttcccattattcttattagtatgatcttgttttttcatcaccaaatttgtgggatcagatacagtgttcattaagggaattactgaaatctcttccacatacgcactgatttttctatgttcaaactttgagtcaatatcagttcccaaatccacagtatcaccaacttttaattctacatcattttggcgtattttaaccccattaacaaatgtcccattgctggactttagatcgcgaatatatatctttcctgatgtaggatcacaactgagacaagcgtgatttctggaaagaactcttgagtcaaaatttccgttatctggtctaacttgttgcgaaaataaatctcttttcgatcctgaattattcttgtttacgctattggtaactggtcgacctaatttaagtccgtcaggtttaaatggtacaacaagaaacttggtctcaaaagttgcatttaaggatttgagtataataatatgtgtatgcttcttacggggtgatccagttctaaataatgtctcagttgaaccattttggaatttcgataattcgtccagtgccggtggagatacggcttctacaggaattgttacttgtccagccggtgttgggtctattgaattgtcattttgatcctgactttgattttcaaatggagaacggattttgttggctaatattggggataattgttgctgttgtgaaacttgatggacggaaggtggagatgaagcggtaggcaacaaatctaagcctggtggtatggtatactgatctatatcgacatttgaacgggatccactgcttctcgagtttgatctagctcttcccatgggcctcttaggcggtgacgtttctggcgtctttgtcattccctgcgaattcgattgatccctaacatagggagaatgttgcagttgcggagggggccgtcttcttttttccagttctaccatgccaagaatttacagttgtcttccttccttctaatttccagttggtgagactggtgactatccgtggggtccggattgcgatttactttcattatgtatttattattggcgattataaagtttgttttcacagggcgtagtagttagcaacaatgaaaatgaataataaacagatcacagacgcatatatctgtgtacgaattgaaggataggcaaaataaccatgacagatgctttggaacagagcgtccttgcgttggagggaacagtttcagtattgaaggattctgtggagtctttaaaatgtgcaaatgagccaagcacgaaccttgcatcgacaatgttgcaaaccaaaagggttttccgtttagttcccgaatatgatgttgaaagatcaaaattagatttgattgaagaggtagaaccgctggttaggactctgggcgataagttacgtaaatctatgggtagaatgcaaagggaactcgatactttgcagcaaacttatgaattaaacgatttaaggctaaagaagaacattagtatggatgacgatgatgctctgaatagtccagacatgggtcaagaatacgaaggcagagacgcggacgacgtggttatgatggcatcttctactaatgaggaattggaagaattgaagaaactaaaggaaaagaagaagcaactggagaataagttggaaatactcaaacagaaatagttagaagtttattttttaaagcatccatttatctctttatccagtttgtattataaattattgttaatgttatcgctagtagattacttatatgtacttaactgtttgctagctaccaaatttgcttgatggttcgccatcgaagctttgagactgttcaatttggcgcttatactgatcaaagttggatcacttgtagatactattaacttttcacattccatgactaccctattatcgaaagtaacgccccttcttaataattcctgagcttctggaagtgttatagcttcactttgaaaagaagaaattatgtggttaagtaatgtggaatcctggacttgtacaccgttttctgagaggatcttagataaagttttgtttctttcatttgtcacttgatttcttatttggtcgcaaaatgacctgccagttttactatcaatctcgcaccaaggttttttagtcaccttaattagatttcgtagttctatgcaaagctcattcctacaaagcgtaagttccagtcctaggatgtgagctgtggattcgcagactgagtaacaatcctggaacatttccttcatagcaaagttgttatcttctgggaataccaggtctctaggaggattttgtaaaagtattagagaatggttcaaaagttccatggccacgccaaatttggatacgaattcgctgacatctgtagctacttgaagttgattcagtatttccaaaatatttttcaagtgcgtcattatcttactgaattgaataagtaagaaattcagtcccgtattcattcggaacataacttgtttacccctttgaaattgtgggaatctgacaacaatgtgaaagtcaacaatgtattggccttgtcttgtgataacaccctttaccgtcggagagtcgttttgtttgttactttcgttgggaataccattagatacaggcattttgaatatttggtcactctctagcatctctaggcatttagaaaagttgtcaataatgttgggtaattgcggtttgacgatttcttcgatgagccaggagcattcttttacggcatccttaaagttgtcgtatttatcttctgcaccaaatctatcatttggaaacaaatcaacactcatattgcttttcgagcacttccactgtgtgcttgatcagatactataattttgtaattcactcaaccccgaattgctccattcagtatatatacttcatataacttttgagagaaaaatagttgcggtttgtggaaaagaaggggaggaaagcaattagctacaaaaaaggacaagtaaaagagtatgttgaggttatctttactgagatcaacagctactttgccagtgaaatgccaacgtcgtgggctaatattacctgcggcggcaatgtacaccttaggctcattaatatttggtaaggaagcaaggttggcggatgccatggaacgtggtgagttacataacaagaacgttgattatgcgaaagaagctgaagagcgtaccgagttacgtattagggccctggctaatactcggccaatggaacctcggtacaacggccatgttccccttcatcggtacgagaaattgctgctgtttgcaatttccggttggaattcatttttccatcctgaagatggttataatattgtacaattgggtgaggcaactgcattgccggtcttcttggagaatttgaagcaaacaatgttaagtgattcctctgggaggcgcattttgaaggaacaacccaatatcacaacagagattttgcatatggacaaactagctaaattgccacataacacgtttgggtatgtatattaccaatggttgaaaagagaaaacgtttctccggacactagagcacctgtcaaatttatcgacgatcctatgcatgcatatatctttaagaggtatagacaatgccacgatttctatcacgctataaccaacatgcctattatcattgagggggagatcaccataaaggctcttgaaggtgccaacctgggcgtcccaatggccattctcggtggtatccttgcacctttacgtttgaaaaaggtgcaaagaaaaagattatataatatatatctcccttgggctgtcagaacaggtttaagctgcaagccattgatcaacgtgtattgggaggaaatgctggagaaggatgttactgctttgaggaaagagctaaagataacactccctccggatctaaggacaatgaggaaggagcgtgcagcccttaggaaggagattgacgcaaaatacaactcacagaaacgagccacgactccagcatgaatcagcagaacaacttttatctctcgcccatgaagttagatattattatttagtcagctataatatactatataggatggtcgtccaaggcgatcttgcgatctctcatctttaagaaaagtaaggtcgttgatattattgacattaaaggttatggatagaggcaggtggtgtttcctcgtgtccgtatcaagcagaataatgaatctgcaagaactattagcgaaagtaccgctgttgttatcgtatccgaccattattctatccagtaatctgatcgtaccttcccataatgatctcatatcacgagcagcctctacatcagcagcagagtatgctgacgaaaagctaatatttttcagtacagatcatgccatcagactgatttttctgccaaccttcgtagcttcttcctttaacctatttgcgcactattttaacttcatcaattactctagccgaaggaagtattatgttttatttactgcaatttatttcctatccatattgactgcgattttccatccaattcagtcaacatgcatcactctattgattatcaagctcctgactaccgctgatgagtcttcgccaaaaattgccctcaatttcaagaccattttgaaaacatttgttccctttattactttaacattagttatattgcgttgggatccttcttttgatgccagctcaggagatgtgaacaaaatttctacgtctttggccgcatatgctctcttaatattaacgctaagatatgcatcaccgctgatattatcgacgttatcaagtagcataggtgttgtttccaaagacaccagcgtcgcacagcattcgataagtagaaataagagatttccgctaattctcgtgttaccgattttttcctttgttcttttgtatctaatgactatagttaacaagacttacaatatccagttattaatggtatttgtgttttttggatgtctgtccattttctttttatcgttaaaagatttgttcacagaggatggaaatcaaaagaagggaggccaggaggatgaatattgtcgtatgtttgacataaagtacatgatttcctatttatggctgacaaggttcaccattttattgacaggcataatggctattgtagtacattttttatcgtttaatgaaattacttcttccatcaaaactgatttgttaagtttacttttcgtcgtagtggcagaatatgtttccagtttctctaacaaacaacctgattcgcactcccataatcatgcacatcaccattcccatctaaccgattcattgcctctcgaaaatgaaagtatgttcaaacaaatggcattgaataaggacaccaggtccattttttcgtttttattgttgaataccgctttcatgtttgtacaacttttatattcctttcgttccaaatcattgggcttattatctgattcgttgcatatggccttagattgcacatctttgctcttaggtctaattgctggtgtattgaccaagaaaccagcaagtgataaattccctttcggtctaaattatcttggtaccttggcaggtttcaccaatggtgttctgttactcggcatagtgtgcggtatctttgtggaggcaattgagagaattttcaaccccattcatcttcatgcaacaaatgagttgttggttgttgctacgttaggcttattagtgaaccttgtaggtttgtttgccttcgaccatggtgcacatgatcatggtggtactgataatgaaaacatgaaggggatttttttacatatattggcagatacattaggttctgttggcgttgttatttcgacgttattaatcaagttaacacactggccaatttttgatccgatcgcctctttattaattggttccttgattttacttagcgctctgcccctgctaaaatctacttccgcaaatattttactaagactggatgacaagaagcataatctagtaaagagtgcgctaaaccagatttcaacgacgccaggaatcacaggttatacaactcctagattttggccgacagagtcaggcagttccgggcattcacatgcacacacgcattctcatgcagagaatcatagccatgagcatcatcatgatcagaaaaacggttcacaagaacacccgagcttggtgggctatattcatgtacagtatgtagacggcgagaattcgacaattatcaagaaaagagttgaaaaaatattcgaaaatgtgtcgattaaagcgtgggtacaagttgagcctcaaaattccacttgttggtgccgggctacttctatgaacacaatttcagctaacccgaattctttaccgctacagcctatagcaaattgacaattctttgtcctgcataccttttatattaattttttaaacaagatttcatatacataacggtacctatcgtaattattggcggctgcttgtgttgatcacgtcttacgggaaatatcacaatggaagaaaaaaaatacttctaacgaaggaaaagatgtcatccagcattgacctcaaattaccgaagaggttgataaagcaattagcatccaatcggtatcataattcggaaattaagggggaatcctctacatttggtgtttcttctttccatatattttgaatgtttttttcctatgaaaagtgtcttcaggaatcatatatgtaaagagatcattcaattaaatacatcatcgaactaagattataaacaagaatttaacaaagtcacttaatatatcaaaaagaaggcttttaggaactcaaaaatccgcatcatttgcaatttaaaacgtacgtcatcaggcgtatatattcaaagaaaatatctcagtttcattgcactggcttacagttgatatttcaattaaatggaaccatcgaatacccaaaaagaagatcttcctaccgcttttaatggtataaaaagtcaattaaacagcatattaaaatcgaatcaattatttcaagattatgcgctattaaatgggttcttggcatttgttcattccaaattgaatgccgcaatccttacatctatagaatcacaatgtgggaaatcctttgcggctgatcttgattcttttgatcagagcagtatctcttcgattttagatttttcttgggaaagcgttcactatccaatattcaaatggtttcagatgtggaggaattatattctttttgagaaggagaataaaaaacagcagaccaaatttatcgactttagaaagatgaattcgaagatgttaaaattcttcaaaacggtgcaaaacttctatgtcaacgttatcaacacggtttataagaaatatgatatatctgtacttttgccgaaaaggattatccaagacttaaagttaagtgacatcgaaaataccactaatgttggagacattcttgcggtgaagacatttaatagtagtagcccactcgcacatctcatcccaacgcttttccatcgctgtctcttattcttaggaacagcgtatcgttataaaactctcctcgaagaaatttccaataaatacagcatatccaattttaaaaaatctctggacttctttcgtttagcttcgttggtgttaccaagtgctggtgagacgtattcgcaagcaggagcgatattccttcaaacaggaaatttggggattgcagtattcaattttgttaaaggtatgatgacgaagatgccaagccctgtttcaatcaaaaattttggggcattaatggtggacaataaaagttcattaaatcgtagcttgcatactactatcatgaacacttacttacaagaatctaaaggacccaggacacctgctaaagagatactagaattttatttcctgggcctttttgggtctgtttggtcacctaccagttggagagatgatacaaaacctaaccaattaaataacggtatcaagttaaggcatttggaaaatgcactctacgagacgatgtcagcaagatacctgaataatattaagaccatctttcacaatttgatcattacaattggtgggttccatctattattaaaaaggcgttccgatgtaagtgcaaaaaccttgaaggatttacgtagcaatgaattggattacctaaattttgcattcaagtatattgctcacattttaaatgatatcgttaaggaatcatggagcgaaaatcctgaggtttcagaaattctaggtatggtaagaattatcaattgttggataaaagcaaatcccatggttcttcaatattcacaaagtaatctagagtttgttaatgccttggcatacttgataaatgatattgtgaaaaaaaaaccaagtccttcttttagtataacagaacatattcctaaaaggacatactggttcgaagaagacttaatggtgaagggtttatcattcgttaactttcaactatctgattttgacgattatgaaaaaattcttgaaatggatcatagtctcgatagattaattggtaatccgccattatgcgacaagttatcggcatcatctgaaatgctgttaaggttgcaggctgttgtgaatataagttcgcaattattgcagaacaacaactgcggagtagaatggtcagataataaatcacgttatatctttaataagaaaattggatttaaggagaccgttaaaaatagtatgaagacatcgaagcaatccaatgaaaaggccaagttacaaagaaaaaacaaaccttcgaccactaatggctcaatatccatggcggatttggagagacaaatgagaagtagctctttggattctttttctccaactatgggttatagtggttcgtctgtacctatggccccagatacgttcaatgttaagcccagcggtacaataacggggaacaaagtaaatgtagaactgttaaaaatcgaactaagcggtcaaaacgccgatggcgctattacgaatatatctcctggttacagtaacgcagcgatctcttcttcaaattcgacagatgaatcatccttcgatttgaacaacatcctatcttcaatgcaacaaaagcacgcggaaaaatcatttgccaaatccatgcaaggggtgaatgaacaaattccagcgaatgacgtctgccatcaagcccagaggccaatgcaaggtggtctgtattcatcacagcaaccttcatcgatgtcttcattaaactccgcgtatcagaatgcctcgatgcctccatctgcctccatggtatcctatccctatccttttttgaaccagcaggggcaaggggtctttccgccttataatgcacaaaatttacaatggcagagcgaagcttactcattaaagtcaatgaattttgcaaatccaacgtggctaggtgaccagtaccagacatctgcgccgtcgtcagcatatgcgcaagcgcaacggcaaatgtttcaacaacctatgcagcaagatgtggggaagtacatgcaatttccttttgacgcccaaagcaacacggacagcatgaggggaaacagtcggaataatatgttttaatattgttcgttttttatcatagtttttcaaatcttcatatgaatactaggtagaaatttggcttatcagtacgaatgaattacagtttgactgatttgtacacgagaattgacgtataacttcttttgaaagtctttgaaattacatggtagtacatacatatatatatatatatatatatgttatattattgttaattaaatattattatgcgtattttccttttctttattagtatagtattaatgacagtaataataataataatagtaacaatatctctttttttttttcagtgagcttttatttttttttcattgctcttcttttggcctcttttgtttttttcttgatttcctccagtttcatctgttttttctttggatcagatacaaaatctggtttgaacgcgtcatagtgacagtccaatttcaacctttcacagttgaaacagtgcggtctttcctcggtacacttctttttccttaatctacaaatccagcaaccagtacgggaccttgtaccttgagacgttgaggaagtagcattattcgattcttgagaattgtttgcttttgatttcgaagtagtattatttggtcttttctttgatgactgtttcgcctttgattttgccttaggcttgacattttttcctttagatttagcgaaatccggcgaagtagcgttaggataatcagcggtatatgccaagccagaagaagccttcaaagatggagacgatggagctgacgaagttgaggattcgccaagagaattataatcgctattggtttggcttgctactcttgcgtttccaactgaccttctcgattttttcaatggtggaacttccagttgctgttgttgttctggagcagaaaggcgtctgtctattcgcttaccattcttattccaagtaacttgccttgtccttgactcaaaagtgggatctaaaacctttttagagtttagatttaaatggtaaggagacaagtcttgattttggtcctggtcttcatcaaaaacagctgtagaattgttgctttcgaaaatgggttgttgttcggaattatggatacgtaacagaattggtcttaagacaccctttgatggaaaagatgacgaatgaggcctactagccggcacaccgagcgcatttgtgttattcatgtcattgacattggaaatgggtttatcatgagttctatatggggatgatctcatgtttgatagcactgctgctgctgtacccaagtcgtcgtctagtttggtagatgaagatgcagaattcggaccgagcaataatcttgatctcaatccatccaatttagaattgatgtatttcggtggaggtggtgggatgtattgttcatttgtatggaagggactatttctattgttacgattcggcaaatcgccgtaaaaaaacccagtagaaggtcttgacgaagtggcaaacgggtcttcaccgcgattgatattgttccgttgagggttgttgttgtttgtgcttgtaaacgaagatgcggaagttggaggttgagaaggtatttggttgaacctaaaatgctggaaattgtttctgctggtaatggaagagctggtgttcgcatgtcgagagtttgtaggcgtatccgtgtttgaactagcattgttggaggatgattcattcaaagaataagcctcatctctgtatttcgaatttagccagaacgatatgttgatttttgattcgttctcgtccagttttacatttgggtctgttatctctctatccttgttgaaatagaagttcctgggcgccacgcccacggcacattggtcatcatgcacattatgctggacctgagagtcgttagatggactgccgccgcgcttagttccgccgcgcaaatacccgccaatctcattgttattagaggattctctcgaatctgagctttgtatcgaattattgtcgttgttgttggtactgttgtttctgctcagtatcgacataggcgaattggtagtcttaccgttgttcttgttggcgctggtaatgatgagcggcaaatccgatcctgtgcgggaacggatgcccgagcccgtgcccgcgcccgagcctgctgcggtggtaccgggggaagaaaccgctggagcttgtggtggcggcaaatgtattttttttttggcgccggcgacgatagtagtagtggcagtgttactattagtggaggtggaggagtaagggaaaacatcctcgttggttgcagtatactgcggctgaatagcaccggaaatttgtgggtctgtagcctgtgcgacatggccattgcacaatgacttaggatccgaaggtgtattggaaggcgcgagtgggctggcggcagcatgcacagcgttatcgctgtcacggcgatcttgaagtgtagtattggtcgtagtagtagtatcgttttccttaggatcgtctttgatatctccgccactttggactttcaaactcggcgaaccagacggagtatgcacgggagtgttgttgggcgcacatgtcgatttcataatagaaagcaaagggttttcatcgtaggttgtcttgagagattcgatgctagcactggaaattgtaggatggcgggagttagctccatcactaacttcatcttctgcatgttttttgccgtcttggctgctattcatcagcgtggcacgagatgttttattgtgcaaatagtgatgattgttggcggttgtttccatcgaaagcagagaggcagccgcattagattcgtccatgtgtttgctttgagagcgcgccttgtctagcatcgtgagttaaggtccatgcaaatggtttgagtgcggtagtgtcctagttcctgtgcgctgtgcgaaggtgggcgcttcttacgatcactggtctcttgtccttgtcctctatgttcttttcatttttctttttgacggcggcagtttccgcctggcattggtgaaaaggcgccttgaagcacggcggacgtgtcacccggaccgaaacagaagagaagtagcgcagtcttggcaattataggatgcccgaaatccaacgtgcattctattctcgtgattattctcgtgatttcgtgtgcaaccaatggactttaaaaactgcgctctactacttgtagcaatgcatgttttgggcaagtggggttgagtggagtgtcacctcagacgacgtgtcgcttttgtatatccgtttttacggacataagaacgtgccgcccattctgggaaaacaaaacacaggttaaaaaaaaaaagaaaggaatggatggggaatgggacagagaggaaagatagaggtggaaataacaaaagcgtgacaacaaagaagcaaatacggagggacaagcaaagaaaaaacaaggacagaaacaaaaaataggaacaagaagtagcacattcataagcaagagagtacgaaacctgtttacaccccccgagacagttgccctatatcgcttttccctatcaatagtttctaactcatgtcagtcttgcgatcacaacctccttcagttgtaccgctacatctgacaacatccaccagtcgcaaaacagaacaggaaccatcgctattgcactctgcaataattgagcgacatcaagaccgttcggtgccgaattcgaattcgaatccggattcgaaccatcgaataaaaaaggatcgcaataatcacactagctaccattcttcatcgaattcggagtcaaacatggaaagtcctcgcttgtcagatggtgagtcttccactccgacctctattgaagagttaaacccaacaataaataattcgaggctggtgaagagaaactactcaatatcaattgatcctttgcatgacaacagcaataataatacggatgatgatcatccaaacaccataacttctccccgaccaaatagcactagtaacaaggaaatgcagaaatatagttttcccgaaggtaaggagtcgaagaaaataacaacaccctcgttaaactcgaataattgtttggatttggacaattccagtcttgttcacacagattcgtatatacaagacttaaatgacgatcatattttactaaacaagcgcgtttcgaggcgatcttccagaatatcggcagtaacagcaacttccacgacaattaagcaaagaagaaatactcaggattcaaacctgcccaatattccctttcacgcttccaagcattctcaaattctacctatggatgattcagatgtaataaaattggccaatggagataccagcatgaaaccaaattctgctactaaaattagtcactcaatgacttctttgcctcttcacccacttccacaaccttctcaaaagtcaaagcaatatcatatgatatccaaatcaaccacttctttgccgccagagaatgaccactactatcaacacagtcgtggcaccaaccataatcacgctgctaatgctgctgctgttaataataatactactactactaccgctgctacgggtctgaaaagatcagagtctgcaacggcagaaattaagaagatgagacaatctttgctgcataaaagagaaatgaaaaggaaaagaaaaacatttttggtggatgacgatcgtgttttgatcggtaataaagtcagtgaaggccatgtcaactttattatagcttataacatgctaactggtattcgtgtcgcagtgtcacgttgttctggcataatgaaacctttaactccggcagactttagatttacgaagaagcttgcctttgattatcacggaaatgaattgaccccttcttctcagtatgcatttaagtttaaggactactgtcccgaagtctttagggaacttcgtgcattattcggcttagaccctgctgattatttggtttcgttaacttccaagtacattttgagtgagttgaactcgccaggtaaaagtggttcatttttttattattcgagagattacaaatatattatcaagaccatacatcattctgagcatattcatctgagaaagcacatacaagaatactataaccatgtaagagacaatccaaacactttgatttgtcaattttatggtttgcatagagtgaaaatgcctatatcgtttcaaaataaaattaagcatcggaaaatttacttcctagtcatgaataacttatttccaccacacttagacattcacattacttatgatttaaaaggttccacatggggccgttttaccaatttggataaagaaaggttggcgaaagatagatcatataggcctgtgatgaaagatttaaattggcttgaagaaggtcagaaaattaaattcggtccattgaagaagaagacttttttgacacagctgaaaaaagatgtggaattgcttgctaaattgaatacaatggactattccttgttaattggcattcatgacatcaataaagctaaagaagacgacttacaattggcggatacggcatctattgaggagcaaccacagactcaaggacccataagaaccggtaccggaacggtagtacgacatttttttagagagtttgaaggtggaattcgagcatctgatcaattcaacaatgatgtggatttgatttattacgtggggataatcgatttcttgactaattactcagttatgaagaaattagaaacgttttggagaagtctacgccatgataccaagttggtgagtgccatacctccaagagactacgccaataggttttacgaattcatagaagattctgtagatcctctgccccagaaaaaaactcaatcgtcgtatagagacgaccctaaccagaaaaattataaagactgagtagggcacaggtaaataacctatcgtctatgtactcagtctaatctactttgatttaatttaattcaagttatataaatctattcttttccctttaattttaatattttaatttcaatccttttcttattttctatttttgctttttttttttcttttttccatattctcaggccacgtcaggcttgcataagccacgctagctaataattcagcgagaccctattccaaacctaattgttcggaaccatgccatatctcttccgcagtgtgtggctaagcggctttaagaggatacgaaatgtcaaaaaacgagaaaattcgattatatctgtacgaacttttctttgcgcttactgcctgtttactttgctttgccttctactgtttttttttgctcgaggccgatggtgaactgcaacgttatataaactaaagtgccagaataaaaataaagaaaggcaaagggagactatccgtcttcgaaacaagtcaaaagagcgaaaactaatgagccaacaacaaggttactaccaacaaggacccccacagcaaggttattatcaacaaggtccaccacaacaaggttattatcaacaaggtccaccgcaacagggttatcctcagcagcaaccagtctatgtccaacaaggtcaaccaaaggaggaaagctgcttggacagttgtttaaaatgtttgtgttgttgtttcttattagaattggtatgcgataactgattcgtttgttcaagaagtggtcaatataaaaaacgaaatcacatagcctttcatctatgctgcgaaagactgtataattacttttaagcaaaaatgtatataatatgatgggatcgttacgttggaacaagaattgaccatcgttcatctgttgttgaaataaaatttgaagttattcgtcgtactagtatcctatcacatgcggtgtaagaaatcacattgtatgagaagcaattatctaatttaatggacgctgaagttcaagaattggtaatgtgacaggataattaattaacagcatataaaataaaagaataatatttttattatataaaaatatcgatcactcttgtggatttctaaatcctcgaagagaacttttaatgcattctatatgcctaataataaagtcgctatcgaaaatataatatctatgcttatctatattgagaaatggatgaaatttgagataattgttgggattccattgttgacaaaggctatgatattaggtgtaaatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatccttgaggagaacttctagtatatctacatacctaatattatagccttaatcacaatggaatcccaacaattacatcaaaatccacattcccaacatggtagcgcctatgcttcggttacttctaaggaagtcccatcaaatcaagatccgttagccgtttcagcttccaatttaccggaatttgatagagattccactaaggttaattctcaagaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccatctatgatgacgtgttcacattatcaaacgtcacctgcgtattatcaaccggacccacactatccgctgccacagtatatcccaccgctgagtacttcctcacctgatccaatcgattcacaggatcaacactctgaagtacctcaagctaagacaaaggtgagaaataatgtcttaccaccacacactttaacatcagaagaaaacttttctacatgggttaaattttacatcagatttttgaagaactctaatctcggtgacattattccaaatgaccagggtgaaatcaaaagacaaatgacttatgaagaacatgcgtatatatacaataccttccaagcatttgccccatttcatttattgccaacatgggtaaaacaaattttagaaattaattattctgacatccttacagtcctttgtaaaagtgtgtccaaaatgcaaactaacaatcaagaattaaaagattggatagctcttgccaaccttgagtacaacggaagtacatctgctgatacatttgaaattacagtcagcacgatcattcaaaggctaaaagaaaacaatatcaatgttagcgacagattggcctgtcaactaatacttaaaggtctatccggtgatttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacgaaggttacaactcgtaattatcatagaacaaatagttcaaaaccaagagcagcaaaagctcacaatattgctacatccagtaaattctcaagggtgaacagtgatcacattaatgaatcaaccgtttcatcacaatacttaagcgatgacaacgaacttagtcttaggccagcaacagaaagaatctaagccaacacgcacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaaccaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaagaatcggatattgaatggtctaacgctagcacatatcaatgtcctgactgtctaatcggcaaaagcacgaaacataggcatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgccagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatccttaaaaaagacagtagatactaccaattacgttatattacaaaacaatcaaacgaaattggaccagttcgactacgatacactcacttttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgatttctcgtcccaatcattgaaccctttacaattagacaaggaaccagtccaaaaggtacgtgcaccaaaagaagttgatgccgacatatctgaatacaatattcttccatctactatacgatctcgtacaccccatatcattaataaagagagtaccgaaatgggtggtaccattgaatcagatactacttcacctagacactcgtctaccttcactgcacgaaaccaaaagcgacctggtagtcccaatgatatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaacccataaatctcctacggacacttctgatgttgcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcattgtcaatcgcattagacaatgactattatatcacacagctggacatatcctctgcttacttatatgctgatatcaaagaagaattatacataagacctccaccacatttaggtttgaatgataagttactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgacgacatgattttatttagcaaagacttaaatgcaaataagaaaatcataacaacactcaagaaacaatacgatacaaagataataaatctgggtgaaggtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtgcatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatccttgaggagaacttctagtatatctacatacctaatattatagccttaatcacaatggaatcccaacaattacatcaaaatccacattctctacagtaaagaatatactggaagttctcctcgatgatataggaatcctcgaaatggaatctatatttctacatactaatattacgattgttcctcattccgtttttatatgtttcattatcctattacattatcaatccttgcacttcagcttcctctaacttcgatgacagcttctcataacttatgtcatcatctaacaccgtatatgataatatattgatactataactattagttgatagacgatagtggatttttattccaacatatattcactcgtttctccgaatgaaaataaataacatctattgactattcctttttgttgatatatcatcatatgtggtgaaagaagatgacaaaaaaattgagaacaagaaatgccaaggtggataaaataatatgataataagcaacaatatataaaatgaaagaggaaataatatcatcattacttagaaaatacgactcatctctgtgtcccctaggaaaagttcaagtatatcctaaacctgatactatggctgagaaatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgtttgttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcacttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgcactttctctttgtattcatcttcatctatttctagttcatcctggtctatataatgacctggttgacctggagctctaagtttctttccttttgggttcaaaggtacgtttagtttgggtaatttttctgtcaaggatttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcatcaacgcataatgatgtacagtgttggattgcatacctgtatcgtacgtatcaggatgctgaatgtcacctcttgcaacaaatctagctttatgagttccgtcacgtttcttgttgaagataaacattgagtttattactcttttagggtctatttcttttctgtcataatatttgtcagtgtcccaagtattcattttcaatagttggttgacttctttgtggtatgcttcgatatatttttccttttctttaatatctttattataggtgattgcctcatcgtatcttaaagttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtacgacgactcatgtgtgttagattgggacatgggagcaagtaaaggaacatctaatctatgcataccacccgaatcggtactctcgatatcggaaatttggggggtgctagatctcttcttagatggaagaatattagattcagatatgttggggtcaacttctctgggtgcgcgaatattggttttagaaacacgtttcgaatcttcagtatgagttgacgggggtgtggaatcggttggactcacagcttttgaaaggacatttctcggttgctcaggatatagttcaatatcagattgaaagtcatggtctgattctatgttaagatcattggattgttggatctcatttgacgcaatgaacgattgatatgaagcagttaaacggtttaagtcttcatcgaaagtgagtgcgtcgtaattgaattgatctaatctggagtccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactatttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttaatagatgtggatacattgtgagccctggctgttttcgatttcgaattatttgttttttgaggattccgagctataactttgggtttggttgtattcgtatagctgcgagaatcattcttctcatcactccgatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacaatggcctctttaacactaatatcccgacaattttcccaaaattcaaagaattctcagaaagagctatttttttttttaataaaattattagtactaattccagtataaataacaatgttatttacgtctctttcgaaaatgctcgtgtagctcagtggttagagcttcgtgcttatagcaacattcggtttccgaagtttctgtgccaaagacctttcaaacaggcctttaaaagcaacgcgaccgtcgtgggttcaaaccccacctcgagcactttctctttttttttcacacgcgtttgcaacatgcccgtattacatgagcttatttgactttagatggttttcagttcttttttttttttttttttttttcagtagattaatgcgaagagttaaatcaccaattcaaagatggcagatggaccaccttgtgggataagtataaaaataactaaaagtggtcttgtgttaaaaatagaatagaaaccactcataaggcaaaagatggctggaaaaaagggacaaaagaaaagtggactaggcaaccatggaaagaactctgatatggatgttgaagatcgtctccaggccgttgtcttgacagactcttatgaaactaggtttatgccactgacagctgtcaagccaaggtgtttgctgccactggctaacgtacctctcattgaatacaccttagaatttttggctaaggctggcgtacatgaagttttcttaatttgctcttctcatgccaaccaaattaatgactatattgagaattctaagtggaacttgccttggtctccatttaaaattaccaccattatgtctccagaagctagatgtacgggtgatgttatgagagatctagataatagaggtatcattactggagattttattttagtcagtggtgatgtattgactaacatcgatttcagcaaaatgctagaatttcacaaaaaaatgcatttgcaagataaagatcacatctcgacaatgtgtttgagcaaagcgagtacctatccaaaaacaagaactattgagcctgccgcatttgtcttagacaaatccaccagtaggtgtatttattaccaagatttaccattaccaagctctagagagaagacttccattcagattgacccagaattgttggataatgtcgatgaatttgtcataaggaatgacctcatcgattgtagaattgacatttgtacatctcatgtacctttgatatttcaagaaaattttgactaccaatcattaaggacagactttgttaaaggtgtcatttcaagcgatatattgggaaagcatatatatgcctatttgacggacgaatatgctgtaagagttgaaagttggcaaacttacgacaccatttctcaagactttttaggtagatggtgttatcccttggtcttagactctaacatacaggacgatcaaacgtattcttatgaatcaagacatatatacaaggaaaaagacgttgttttggcccaatcctgtaaaattggtaagtgcactgcaattggatcaggaacaaaaatcggagagggtacgaaaattgagaattccgtgattggaaggaactgccaaatcggtgaaaatattagaatcaagaacagtttcatttgggatgactgtatcatcggaaataacagtataattgaccattcattaattgcctctaatgccacgttagggagtaatgtacgcctaaatgatggctgtataattggtttcaacgttaaaattgatgataatatggatttagatagaaacacaaaaatatctgccagtccattaaaaaatgccggctcaagaatgtatgataatgaaagcaatgagcagtttgaccaagaccttgatgatcagacactagccgtttctattgttggagataagggtgttggttatatttacgaaagcgaggtgtctgacgatgaagatagttctacagaagcctgcaaagaaataaacactttgagtaaccaattagatgagttatacttaagtgacgattcaatttcttccgccactaaaaagacaaagaaaagaagaacgatgtctgtcaatagtatatacacggatagagaagaaattgattctgaatttgaggacgaagattttgagaaagaaggtattgccaccgtggagcgtgctatggaaaacaatcatgatcttgacacagcattattagaattgaacaccttgagaatgagtatgaacgtgacatatcatgaggtgagaatagcaacaataactgcattattgagaagagtttaccactttattgcaactcaaacattaggtcccaaggacgctgtggtgaaggtttttaatcagtggggactgttgttcaagagacaagcctttgatgaagaagagtatattgatttgatgaacatcataatggaaaaaattgtagaacagagttttgacaaaccggatttgattctatttagtgcattggtttctctatacgataatgacataattgaggaggatgtcatttataaatggtgggataatgtttctactgaccctcgctatgatgaagtcaagaaattaactgtaaagtgggttgagtggttacagaatgctgacgaagaatcttcctcagaagaggaataaaagtccacgcagtaccctgcataatcatgtattaccataaaaaggctttaatatgagaaaaaggtgagcgctatatagatttagtaatttacatgttacagaagcaaaaagcaaatatatatatattttttatcatattagtttttatcctcagtagtactactgaaataataatctcagatttttttttttcacttgccgagggaccttgtcctaagtggcaaagaactgaaaaaaaaaaaaattgaaatgcggtggtatcacatgaagagtaaataacttaagcaaaagagaggccactgagagagtacaagaaagggacaataacaatagacagaagacttttatatttgtaataacttagcgatgtcccaattattcaataactcgcgctcagatacccttttcctaggaggtgaaaaaataagtggtgatgatattcgtaatcagaatgttttggctactatggctgtggctaacgtcgtcaagtcatctttaggccccgttggactggacaaaatgcttgttgatgacattggtgattttaccgtcaccaacgatggtgccactattttgtctttgttagatgttcaacatccagctggaaaaattttagtagaattggctcaacaacaggacagagaaattggtgacggtactactagtgttgttattattgcttctgagttgttgaaaagagctaatgaattagtcaaaaataagattcatccaactaccatcataactggtttcagggttgcattaagagaggctattcgttttataaatgaagttctttccacaagtgttgacactttagggaaagagacgttaattaatatagccaagactagtatgtcctctaagatcattggtgctgactctgattttttcagcaatatggttgtagatgctcttttggctgttaagacgcaaaattccaaaggagaaatcaagtatcccgtaaaggctgtcaatgtgttgaaagctcatggtaaatctgccactgaatcactgttggtgccaggttatgctttgaattgtacagttgcttctcaagcaatgcctaaacgtatcgccggtggcaatgtgaaaatcgcatgtttggatttgaacttgcagaaagctcgtatggcaatgggtgttcaaatcaacattgatgatccggaacaattggagcaaatccgtaaacgtgaagctggtattgttttggaaagagtgaagaagatcattgatgctggtgctcaagttgtgttaaccaccaaaggtattgatgatttatgcttaaaggagttcgttgaagctaagataatgggtgtaagacgctgtaagaaggaagatttgagaagaattgcacgcgctacaggcgccactttggttagttctatgtctaacttagaaggtgaggaaactttcgaaagcagttatttaggtctttgtgatgaagtagttcaagccaaattttctgatgatgagtgtatcttaattaagggtacttctaaacattcatcttcttcgatcattttaagaggtgccaacgattattctttagatgagatggaacgttctttgcacgattctctttctgttgtcaaaagaacgcttgaaagtggaaatgttgtccccggtggaggttgcgttgaagccgcattgaatatctatttggacaattttgccaccacagttggttctcgtgaacagttagctattgctgagtttgcagctgcattattaatcattccaaaaactttagctgttaacgctgccaaggattctagtgaattagttgcaaaattaaggtcctaccatgccgctagtcaaatggccaagccagaggacgttaagaggagaagctacagaaattacggcctagatttgattagaggtaaaattgtggacgagattcacgctggtgttcttgagccaaccataagcaaagtcaaatccttgaaatcagcattggaggcttgtgtagcaattctaagaattgatacaatgattacagtggatccagaaccacccaaagaagatccgcacgatcattgattctttgcgtaatccgaacgagattctgtatctgcatgtaaactaataaacctatataaaatttaattatatttttttcagctagttctatttttgaatttgatcgctaactctgggcagttgataagcgcttcccagcttttcacgtgcgaggtggactaatacgtaataacgcgtacctattaggacttcgttgagttgtttttcttgtccaaatgcagaagcgggtccctacaaactattgtgtttgttcgtaaacgagcaggaaccctgttaaaggaaaaaagcttaacgctagcgttacattttagtaaggcggcaataaaaaagaatgcggagtgtattccatgaattcaattgcgcttactgctaagcctgtttctaaacatgatccccagggtgaatatctcccatagtggctgtgttattctgtctaaatgtggcagctaaataaggttttttccaagctatttttttctctaaacgagcgcaccttagcgggatcgcgtcaaattttcgcccaacgaatattattctattgtcttcagtgaatgtgcttgtcgaaatctatatatgcgccgccctggcaggatcagcaaatacaagttacttggaaagtcgcggcatagaaagtagacacttcttttgtcaaagattgatattgctttcagggtgcgatagtgctgactgttcctctaaacagcgattttttacatacattaactttttgaagttgtaggaactatcttttctcatttatccaacactaaaacaaaattgagctttccagaaatagtgaatcaaaaaaagttaagtacaaatatttacagttcagcagtatgagcgaagtcggtatacagaatcacaagaaagcggtgacaaaacccagaagaagagaaaaagtcatcgagctaattgaagtggacggcaaaaaggtgagtacgacttcaaccggtaaacgtaaattccataacaaatcaaagaatgggtgcgataactgtaaaagaagaagagttaagtgtgatgaagggaagccagcctgtaggaagtgcacaaatatgaagttggaatgtcagtatacaccaatccatttaaggaaaggtagaggagcaacagtagtgaagtatgtcacgagaaaggcagacggtagcgtggagtctgattcatcggtagatttacctcctacgatcaagaaggagcagacaccgttcaatgatatccaatcagcggtaaaagcttcaggctcatccaatgattcctttccatcaagcgcctctacaactaagagtgagagcgaggaaaagtcatcggcccctatagaggacaaaaacaatatgactcctctaagtatgggcctccagggtaccatcaataagaaagatatgatgaataactttttctctcaaaatggcactattggttttggttctcctgaaagattgaattcaggtatcgatggcttactattaccgccattgccttctggaaatatgggtgcgttccaacttcagcaacagcagcaagtgcagcagcaatctcaaccacagacccaagcgcagcaagcaagtggaactccaaacgagagatatggttcattcgatcttgcgggtagtcctgcattgcaatccacgggaatgagcttatcaaatagtctaagcgggatgttactatgtaacaggattccttccggccaaaactacactcaacaacaattacaatatcaattacaccagcagctgcaattgcaacagcatcagcaagttcagctgcagcagtatcaacaattacgtcaggaacaacaccaacaagttcagcaacaacaacaggaacaactccagcaataccaacaacattttttgcaacagcagcaacaagtactgcttcagcaagagcaacaacctaacgatgaggaaggtggcgttcaggaagaaaacagcaaaaaggtaaaggaagggcctttacaatcacaaacaagcgaaactactttaaacagcgatgctgctacattacaagctgatgcattatctcagttaagtaagatggggctaagcctaaagtcgttaagtacctttccaacagctggtattggtggtgtttcctatgactttcaggaactgttaggtattaagtttccaataaataacggcaattcaagagctactaaggccagcaacgcagaggaagctttggccaatatgcaagagcatcatgaacgtgcagctgcttctgtaaaggagaatgatggtcagctctctgatacgaagagtccagcgccatcgaataacgcccaagggggaagtgctagtattatggaacctcaggcggctgatgcggtttcgacaatggcgcctatatcaatgattgaaagaaacatgaacagaaacagcaacatttctccatcaacgccctctgcagtgttgaatgataggcaagagatgcaagattctataagttctctaggaaatctgacaaaagcagccttggagaacaacgaaccaacgataagtttacaaacatcacagacagagaatgaagacgatgcatcgcggcaagacatgacctcaaaaattaataacgaagctgaccgaagttctgtttctgctggtaccagtaacatcgctaagcttttagatctttctaccaaaggcaatctgaacctgatagacatgaaactgtttcatcattattgcacaaaggtctggcctacgattacagcggccaaagtttctgggcctgaaatatggagggactacataccggagttagcatttgactatccatttttaatgcacgctttgttggcattcagtgccacccatctttcgaggactgaaactggactggagcaatacgtttcatctcaccgcctagacgctctgagattattaagagaagctgttttagaaatatctgagaataacaccgatgcgctagttgccagcgccctgatactaatcatggactcgttagcaaatgctagtggtaacggcactgtaggaaaccaaagtttgaatagcatgtcaccaagcgcttggatctttcatgtcaaaggtgctgcaacaattttaaccgctgtgtggcctttgagtgaaagatctaaatttcataacattatatctgttgatcttagcgatttaggcgatgtcattaaccctgatgttggaacaattactgaattggtatgttttgatgaaagtattgccgatttgtatcctgtcggcttagattcgccatatttgataacactagcttatttagataaattgcaccgtgaaaaaaaccagggtgattttattctgcgggtatttacatttccagcattgctagacaagacattcctggcattactgatgacaggtgatttaggtgcaatgagaattatgagatcatattataaactacttcgaggatttgccacagaggtcaaggataaagtctggtttctcgaaggagtcacgcaggtgctgcctcaagatgttgacgaatacagtggaggtggtggtatgcatatgatgctagatttcctcggtggcggattaccatcgatgacaacaacaaatttctctgatttttcgttatgatagaaaatttaaaagtgcagaatattcgaaatagattcccaaaaaaaaaaaaagggatattgtgttacccagttcacaatggaattttctagaagaaaaaacaaagaagcctcgcaacaaaccaagatggattcaaaatgcctacttaccgcattgtatgtgggagaatgaacatatctgtaattgtattatataaaagtagttagtttttttttttttttttttttttttttttttttatgtgtaatgcaaatacaaaaagaactgcaggcattttgaaagttcactcgtataggaaactttgatagagaggcaattccttactttcgttattcctttcagtcttattcttaatcgtttatagtagcaacaatatatcaatatggtcgtgaataacccaaataactggcactgggtcgataagaactgcatcggatgggccaaggagtatttcaaacagaaactggttggagtggaggccggttcggtgaaggataaaaagtatgccaaaatcaagtctgtttcgtccattgaaggtgattgtgaagttaatcagcgtaaggggaaggttatatctttgtttgatttgaaaatcacggtgttaatagagggacacgtggactctaaggacggatcggcattgccattcgagggtagcattaacgttcctgaagttgccttcgatagcgaggcctcaagctatcaatttgacatatctatatttaaggagactagcgaattgagtgaagccaagccactaattagatccgagttattgcccaagttgagacaaattttccaacaatttggcaaggatttgctggccacccatggtaatgacattcaggtgcccgaatctcaggtgaaatctaactacacaagaggtaaccaaaaaagtagctttaccgaaatcaaggactccgcttcaaagccaaaaaagaatgcacttccctcttctacttcaacttcagcaccagtctccagcaccaacaaagtcccccaaaacggaagcggcaatagtacatctatttatttagaaccaacttttaatgtgccttcctccgagctctacgaaacgttccttgataagcaacgcatattggcctggaccagatcagcacaatttttcaacagcggaccgaagctggagaccaaagaaaaattcgagctctttggcggcaacgtgatcagcgagttggtttcatgcgaaaaggacaagaaacttgttttccactggaaactcaaggattggtctgcccctttcaactctactatcgaaatgactttccatgagtcgcaagaattccatgaaaccaaattacaggtgaagtggactggcatacccgttggcgaggaagatcgcgtgcgcgctaattttgaagaatactacgtgcgttctattaaattgacattcggctttggtgccgtattataagatatattgttctcatgtttcaataaaagtatgcgtaaatatttacataccactattggcatagatagaatgcaatacatcatgtagttctgtacggcatccgcgcggctccgatcgcccgtcctacttttgcggcccggcgccgacggcctccccggaatttaccaacgaagaggaaaataaactggagttataacgccattggcgggaaactccgaaaccatagcgccgtggtctttccccggttttttggcgccgggtgtgcttgcgttgtgtgaacggcgccctggcagctgagggggaagggaaacgccggaggcgacggcaaggatgaccatggcgtcaaggaacatgcggaacatgctagaatgattgccgaaaggcgggccctagtcaatggcatcatgcgggaacgtgcagtaaagctcaatgtaacttgatgcctatcggcgttgttcgagctaaggacgatgtgatagactgaggaagggtgaacgtcgatagttagccgttgtgaactaaataaaagtgatattttttcgttgttcttttcttggtttggcggtgttttcatttgttttcatgttttacttcgccacaggttttcaaagaacaacgccttaaaaataggaaaacgttttcgctacaggtgttgttattattgttgttgtgctgttgtttattgtgctatacttgtggtatttattctggacttccgatcggaaattttcttcccttgaagaccttttgaagacaacagttatatatcattgatctgaatttctcaggctattttcaaaattccatacctccttattccaacatttgctcgactactatagaaaagccttattcttttatctttgaaagaaagaaaaggtgtcatagcaaaagtttattgttactctgttttgatatactccctcttattcgttggaagtataagattgatttgcataaattaaccaatcattttgctactttcccggttctccctttattataaacacttcagaaaaatattctgctactattccttactttactataagaattttgttttccaaaaaaaaaaaatataaaaaaaataatcatactctattactatggctaacgtagaaaaaccaaacgattgttcaggctttcccgttgttgacttgaattcgtgcttttctaacggcttcaataatgagaaacaagaaatagaaatggaaacggatgattcaccgattttattaatgtcatcatcagcttccagagaaaactcaaacactttctctgtgatacagaggacgccagatggaaagatcattaccacaaataataatatgaactccaagattaacaagcaactggacaagttgcccgaaaatttaaggcttaatggtagaacccccagtgggaaactaaggtcatttgtttgcgaggtttgtacgagagcgttcgcaagacaagagcacttgaaaagacattacagatcgcatacaaatgaaaaaccttatccctgtggcctctgcaacagatgctttactaggagggacttactgatcaggcatgctcaaaaaatccatagtggtaatttaggggaaacgatttcccataccaagaaagtgtcgagaactataactaaagctcggaaaaattctgcatcctcagtcaagtttcaaactccaacctatggtactccagataatggtaattttttgaatcgcactactgccaatacaagaagaaaagcaagccctgaagctaatgttaaacgtaagtacttgaaaaaactgacgcgcagggcttcatttagcgcacaatcagcatccagctatgctttgcccgaccaatcttcgctagaacaacatccaaaggatcgtgttaaattttctacgcctgaattagttccacttgacttgaagaatcctgaacttgactcttcgtttgacctgaatatgaatctagatttaaacctaaatctagattccaatttcaatatagcattaaaccgttctgattcttctggatcaacaatgaatttggattataaattgcccgaatcagcaaataactacacatattcttccggctcaccaacccgcgcatatgtcggcgctaacacgaattctaagaacgcttcatttaatgacgcagacttattgtcgtcgtcgtactggataaaagcctataatgatcatttgttttcagtatctgaaagtgatgaaacttctccaatgaactctgaattaaacgacactaaattaatcgtcccagattttaaatcgactatacatcatttgaaggattcaaggtcctcctcttggactgttgctatagataataatagcaataacaataaggtatcagacaaccaacctgatttcgtcgattttcaagaactgctggataatgatactttaggtaatgatttgttagagaccactgccgttttaaaagaatttgaacttttacatgatgatagcgtaagtgctaccgccacgtcaaatgagattgacctttcccatttgaacctatcaaactctccaatttctcctcataagttaatttataagaataaagaggggaccaatgacgatatgttgatttctttcggactcgatcatccttccaatcgcgaagatgatctggataagctatgtaatatgaccagagatgttcaagccatattcagtcaatatttgaaaggagaagagtctaaacgatccctggaagactttttatcaacgtcaaacaggaaagaaaagccagatagcggcaactatactttttatgggttagattgtttaacgttatcgaaaatatcaagagctctgccggcctccactgtgaacaacaatcagccatcgcattccatagaatcaaagctatttaatgaaccaatgagaaatatgtgcattaaagtgcttagatactatgaaaagttcagtcatgatagtagtgagagtgtcatggactctaatccaaacttgctgtccaaagaattgttaatgccagctgtgagtgaattgaacgaatatttagatcttttcaagaataatttccttccccatttccctattattcacccaagcttgcttgatttggatttggatagcttgcaacgatatactaatgaggatgggtatgatgacgctgaaaacgcgcagttgtttgatcgattaagtcaagggacagataaagaatatgattacgagcactatcaaatcttgtccatttcgaaaatcgtttgtttacccttatttatggccacatttggttctttgcataagttcggttacaaatctcaaacaatagaattgtatgagatgagtagaagaattctacattcttttttggagactaaaagaaggtgtcgcagtacaacagtaaatgacagttatcagaacatttggttgatgcaatccctaatattgagcttcatgttcgctctagttgctgattatttggagaaaattgactcctctttgatgaaaaggcaattgtccgcattatgttcaacgatcagatcaaactgtttaccgacaatttctgcaaattctgagaagagtatcaataataacaatgaacctttaacatttggttctcctcttcaatacatcatttttgagtcaaaaattagatgcaccttaatggcttatgatttttgtcagttcttgaaatgtttcttccatattaaattcgatttgtctataaaggaaaaagatgttgaaaccatttatattcccgacaatgagtcaaaatgggccagtgaatcgataatatgtaatgggcatgttgtgcaaaagcaaaatttttatgattttagaaacttttattacagtttcacgtatggacacttacactcaataccagaatttttagggtcatctatgatttattatgaatacgatttaagaaaaggaaccaaatcacatgtgtttttggatcgaatcgatacgaaaaggctagagaggagtcttgacacttcttcctatggcaatgataatatggcagcaaccaataaaaatattgcgatcttaattgatgacaccataattttgaaaaataatttaatgtcaatgagattcatcaaacagattgatcgctcgtttactgagaaggttagaaaaggacaaatagcaaagatatatgattcctttttgaactctgtgaggttgaattttttgaagaattattcagttgaagtattgtgtgaatttttagtagcgttgaacttttcaatccgtaatatttcgtctttatacgtagaagaagaaagtgattgctcccaaagaatgaattctccagagctgccaaggatccacctgaataatcaagcgctttctgtcttcaatttacaaggctattactattgcttcatcctaattatcaaatttttattggattttgaagcaactccaaattttaagttactgagaatttttattgagttgagaagccttgcgaattctattttacttcccacactttcaagattgtatccgcaagagttttctggatttcctgatgttgtatttacgcaacaatttataaataaagataatggtatgcttgtccctggtttatccgcaaatgaacaccataatggtgcaagtgcagctgttaagactaagttagccaaaaagatcaatgttgaagggcttgcaatgtttattaatgaaatcctagttaactcttttaacgatacctcttttttgaatatggaggatcctattcgaaatgaattttcctttgataatggggacagggcagtgacagacttgcctcgttcagcacatttcctatcggataccggcctagaaggtattaacttcagcggcttaaatgattcgcatcaaactgtttctactttgaatcttttacgttacggggaaaatcattcatcaaaacataaaaatggtggaaaggggcaaggatttgccgaaaagtaccaattatctctgaaatatgttactattgccaagttatttttcaccaatgttaaagaaaactacattcattgtcacatgttagataagatggcaagtgatttccacactttggaaaatcatctaaagggaaacagttgacgattatgtctcgttgctgatatgtgtcgtcccagtactcaactctttctgatgagattttgaatatctcattttatttctcatcaaacagccatgcatgcgactgaagtggactactgcgggagaacaccgatcttatctttgaaattgttgcacaaaaatatttcactaccttggcgtttctcatctcacccattggggtgaatctcgttattgctccttattttggtccattttatattaaatcctgtatcatgtttaacatttttcatcttatacctcatacaaaaaagaaaagctatttatgaaagttagttcattacaagatgcaagcctaaaatatatgcttgatcttaaaattcatgtatagaagaaaaagaccttaccaacgttgttggttaccgtgtataactaataccaatcttgaacattaaccactcctggcgtgtgggaggatgttcttagacttaattaagaatctctaaatttttttttatttaatcgtccctttctatcaattatgagtttatatatttttataatttcatctaacctcagaaatagtgttgtatatatcattgtccgtaatatcatcgtgaaaaccagtgtcctcgttaattattgtctgaattagccattctttagattcagtgtgaaatatgtaattaaatttcttaaatttcagtgatatttgacttctcaatctttcgagaagcttcatctgagatttaccattattttcgttagcatatatgagaaactttaactttcgattagataattctgatcctattctgggtactaaagaatctaaggcatttaacaatggctctgtatcatctacatcaatattgggtaaatcaattgtaagcattctacctgcgctcaaacatgcaaaagcaaatttgacaaaactgtccaactcagatctaccccaaacaataacaatgtagtcatttaacattttcttcactccacatatctgatctcttaaattagatccgcgtaagaattgtgtataaaatgaaaaaatattgttggatttaatgattcctccctttgatggagaatctaacgataaccgaaaactttcacccgaaggtaataggtattggtatattaaatgtggtactattcttttcttttcaatgcatgcacttatgaatttccagtgtagtgtaggccaccccaacgccaaagtttctaagtactttaagcttcttaaatgccgttttgtgattaggcaagcaaatctgcagtctgcaaatagggaatgaggtttccaggctagcttcaaggccaattctcgaatattatctgtattacctttattgactaaagatttagctagcggatgagtgaagttaaataaagtggaaaatcctgactcaattacagtgccgccttgcgattcaatggtctgtcgaagttcctctctattttcgaataggcttgtcaaaacaaaaatacatttatcaaatacattccctgttctgatttcaccagaagaaaaaagcaggcttggcgctcctgcatgttcagctaatgcgtctctagaatcctttttaacaatttccttcttttcggagctcgattctatttcgttattgtacacttcagtatgcgtatttatgtccttttcgtcatcagtatgtttcttcggagacagaacattggtcattgatttccttcccctaatgggatgtctcaagtacctatacgcgtcgcctttatttttctcattatcttctaatatgatcttcgctcttttagcccactcgcttaggtcaagactgatcgagcttagtgctttaattaacgtccttttccccaacaatccgcttgcatttttttttttcaaatgaaccgtatcatatcctcgaatacatcttattatgttgagatcatggctacgacattctagaccaacgactacgtactcatttccatcaaaggtaacagcatcccctattctaatatctaagtagtagatgtcctcatctttggttagcgatcttcctgtttcgaaataaatccaacagccatcttgattagtgtcaacttccaataaaatacccggataaaatttgtaattccacgtatactgacaccataccgcatttccaaaaattatgtcgtctttcgataagaaactattatctgccgttctaataccttcaggaaacacgtaagactgttctttagagtctttgcccgaacctgtctcccctgtttgtatggtaatgctgcaagacggttcccttttgatagaagcagcatccaaatctgaatttcttttgaggtgttttgtcggtgatgtcttagtgcttctgttctcctcctcttcaccgatctctattgtatctttttgacgtcgctttattgttcttcggttctgaataatctcctgtgactcacttggaaataattgcatgaggtttttctgaagttctgagctctgtcctttgctttcgtgttcaatcaaagctacatccaaagactctgtgccatcttgtttatctgaattgcattctttattatcatcatgaagctgaagtgagttccccttgcttttttttatctccattaaagtttcttcctcgactaccagcttttttggagacgtttgaagatcttgctgctcttcaacttcaggcagttcttgggttagttcaacctcgctcatgattgtactttcctttttcgtatcaagctcatttggggacatacgttctgtttcatcacttcctgaatcagatatttgctttcctgaaagttgtaagtatattctatcggttatttccttttgttcgttgaaatcagatgaaccggctatgataatgtcatctctggtagctgcatttgaagaattttgtatatcgtttgaaaaaacattgtttgtctctacttctctctcgtgtatattaaatgtatctttttccttcggaataggtgaagaattcgagggttttgacatcgtattcttagatggtgaactagtctcaggaacttccaatatgggttcaaaattaatccgagaaagagtaacgggagtttcaaaggttgcattcaaagcattttgttcaggagaatttattatttgggtttttatttcttctgtctggccagtagaatgaaaaacaggtcccttctgagcagatatgccttgggaaagcgatgaaacaattatctgtgtctctaattcattatttgtttcggtattgaaacttttagataagggttgcgtatcgattgaaatactatctaaaggcatttcctgtgttcttggattattgactatttgcgtagatctattgctattattttccgttttgtcttttgagtatcggaatatccacttcttggatggttcccgattgtttacactctcactggaatacatttcttcttccgcattgttgcgtgaaggggtgccagacacagcactattaatatcgatatctaaattgttcacgtcattctctctacccgaaacattcagattcttttccaattcgttaatctcctctgattcattactttgtattatttgattgttccgttctctgagatcatctgatgaatagttctcacttttcttttttactggatttttttcctcgatagctcctatgttatcttcgttattgttaaaaaccttgtttacatttcttgtggtccggccattcccggtaattttgttcttgtcataagagcttatcgaattaggtgattctgctgatatcatgatttgagttttttgaactcgttcatcttgcattcctccacttttacttaattcgtctttatatcttttaggtgtaacaattccttccaatgcacagtcataattatcagcagaacgttcagccatctgtacaaaagtggcatccgcctctgtaacttctaatgacgcattttcttctccatcattctgctctccataatagcaaaacccagtatctgacttcaactttttgaaggttttctgttccaatggatcagttggagtttgaaaagtcattttttttcttaacatcagaggagtgtcttccagatcggagctttgatatttggtcaaaagattttctttaccaggggttcgattgcttttgaaaaagttagcaattcggtcaaggtcaggagtcctttcattatgcaatatgttagcatttggtcgatcattatctcctacttcaatatttaactcatcatcatgtcttggactctcgtcaagtaatcccagagatttttgaaatatctcacttgtattcataaacttgacaggatttggatttgctttgggacttccttcgattatgtttgtgctatttaccttgttttccaacggatcaacgggaacattcatttcgttcatgtcgccatcagccaagggagaatgcagtgcttcctttatagcgctttgggtgactcgatctggagagcttttccattgaactaactggcctgacatagccctgatgttgaagattttctcactatgctcttttctatggcgtttctctatcttgctcacttcacattgctcatcgttgcaaatatccacgaacaaaaatcctcgcgtgtttaatcagaactgcactctgaaaattcaaagccgtgccagtaataagaaagacacaaggttatatagagacacatcgagaaagtatattatagattaaaaaaattttgccttatactttagtgcacttgaaaaagcaataaaattttatttcatatgtatctaacgctaacaaggccgtatatttatttagaccttattttgatggggagctgccaacattttctccaataaatcaatcttcctttgatagtcttcaataattctgtttttttcgtctatttctttgtgtatttgataagcattttcatcgtttgtatctggattcccaagtgttctacttgcactatttcttctggtggaaacattgctgacacttccccttgaggtttcgtcgatatagctatagtttggaatatcatagttgtttttcttctcagttaacactttagccctataattttcatacaatacgttgtttgttacatcttttaattcctgaaggtgagaacctaacagtattgcttttaagtatataaaatcggaggtgttttggtcttcgaccaccaagctaccccattcgtacgttctgatatgctcaaccctattttccgaatttttattaaaagttttgctgcaaacaatggcaaatggcgatatttccttgatcttcgtgtcattatcgtatttggattttgctgaactggaatcgatgtccatatcgtacagagctaatgtttcgcctagggtgtcacttttaaaatcaaaaacacgtatattgttctgagagatttcttggcgcacaatgtctttgtgtaaatttaattcagtttctgtgagaccatcggcttttggaataatgggaattaaattaactttatcacaaatcgttttcattaactcaatatcaaattttttgactcctcttggagtactcttcagaaagtataaacaaacatgaggcctcccatcagtttcttttgtgtttctctttattctgacctcttcttttaaaacatttgcaaactgttggtctaagtagttttttataacaacagagctttgtgaattgtcgacattgtcaccgcagcctggaaacaatatgatatctaatgttatgggtacgcctagttcatcgttcaaatacactcttctggtgacaagcttcagcccaggactcaaatgggctgttttatatccaggatctatatcttcgatggcgtttccattttctggtgttacattatttgtcactttatcatcatcatcatcataatccccatcagaaagcgatatatcctgaccgcacagattgtttaaaaacgttgatttgccgctgcctttttctccaagtaacaaaattgacaactgcagtcctttcttgtaacccttgcgacgtcttaactcatctctgctgagagtatgttgttcaagagctgagtgatctttcattgggaacatttgattatttactgactttatgtacgtatagtagctctttttttgtatcgatttataaaaatgcctgttcttactattcttatgggaatgacacaaaatgtagacgcatgtctttttcaggcgtccttaatatgagcgatcaaatttcgcatcaaaaaaactttattgaagttagaatatatgaaaaaaagccacgaaatttctaaaggcaaccacaaattgtcttattattgatagaatataaaaaataagtcatttatttatatgtacatctgtgcaaatggtagcggcgctctttaactgtttctacataccatgcatgcttgtctaaaaccatttcgaagttccgttgctaattcagagaaaactcttccaagcaaagtcggtttgaggcgttttctgttatatattaaaatcggtattagcgtcaagccgtttgattacatgatcattcgtattcgacccactagggttatccaattcgattttgcgatagcatatcttattaccgtctgtaacaaccgcctttaatttgcttctttgatgaggtttggataattctattactggggaagtgtgacttctttgaaatttattttcatcatttttctctgttattcctttacagttcgagctattttcttttataattaattgttcataatttgctatctttgtactgttgactcttttaattgctagaggattagttgtttcaccgttaaaatcgggataatgcctttcaatctcctctaaataacctcttgagacgctccttctgccaactttcggtagtatgtcagaagggggacttatgattttcctaaaatcttcgtcattagcacttaacgaactggataatttcaatcttggattgtcctttttctttgtttttaatggtctgctatctctaaaaattaacttctcaaaaagttcggctttatccttgactttattagattttctcaatcttgtgattgagtcagacgattcagtagatgtaggcgtcatctctttataatcaggatctcgtgacttagtgaaatccattgtaatattattccaatcatcgtccagtagtttgggcgatgaacttgaaaatacagaatttgttgaacttctagaataattagaaaatgtcggagaagggataaaaggtggctttttgactaagtcttcttcaaatgttgtatttttttccaatccgtggagagaatgtatttctccattattctcctctatgtatgtatcatcagaatccgctgaatgggtcctaaatgctttatcattgagttcgatgaattgattcattccttgtagtattgcagtatgagcgatttgctcccttgttatttctgtaggttcgttcaaatccatatttaaatctttcacagagcccttttctttgctctcaacttcatttgttctataacttattgtctttctagccggatcaataacgcctagtttatatttccgctgaacatttcttaatgatgcgaccagggatatgttgtgactatttaaggttttcattgcctttctattaaaattcaaaacatcaaagacatcaacaagaacattttttgtccaccacatattcccgtttgagccgataacagcatttctgtaaacaatgttctcattcgccagcatccttagcaaggtgcaagttttccctatgttttgtaaatcattcatatccaggtgagacaatattcggaacaataggtttaatggtaagtttgtcagggacctttcctccagcggcatctgtacactacaagaaaataatgtcatctatgtggttgaaggaactataactaattctggaacaaaagtgaactttccttgtgcagtttggccaatttgttttgatattttgtatgaggatatttagcaagtagtaacagagactccttggttatttgaaaactttccctttgtttaaactatagcaaagtataactttccttttcctattttgtgaaaaagtaagtaaatattgttatctcctcccaactggttaaatactgggtaggtgcacaagcgtttatagtttctaagaagacagcaccaggaataatgataaacagttgtttgggtcaaaacaaaacgggtattgccaatgccttttaaaatacttacccggccataaaatgaataataatagtgtatgaagactgtgttggaagatgttatggtagaagcagaggcttccgcactgcatttaagaagcataaaggcacttctgctatttcattaagaagattcgctatggtgagcatgttctcattatttctgctattaattgagcaatcgccgcttgtagcgtcattgcaacaaagtcaacggcatatagtgggtgttccctgggaaaagcagcacttgtatgactcgaatgaaccagatttgactaaatggcactgtttgaaccacgaagatatcgtattggatataagccagattaatgatggggtttgtgattgtcctgatggttcagatgagcccggcagcgccgcctgcgtggaagatatattcaaaagcgttgcagagggaggtggtaaagtgaataagtatttttattgtgataacaaggggtttattccaagatatatacgaaaatcggaagtcgcagatggtatttgtgactgctgtgactgttctgacgagctactttctggatatgagctctttgatgctggatctaattgttctcagttaaaaaacgaatttgacattatggcctctaaagagttatcaagttaccgggaaggtaaagaggccctagaagaactggaaagaaaatacggtacaaaggaagaggctatcacccgtggtaattgcttagaagaagataaggaaaaagcttctgccgagataaaagtactctccaacaggctctcagaaaatcgagccaaattagagcagttgagaggcgagtactttaaccaattaagccatgatcccattttgtatcaatttgaacaattaaacagtactcgtttgggatcggacatccttacatcgttcactatggtttcaagagtaagtaaaggttaccaggacatattcaagattttaagtgatttatcagaggcctatactccctcgctaaatgataaagttgtcaatgataatattaaaaaattcagaaaagttagaagacgggctgaaaaggctaaaattaatgcagatagcaaaattgatgatgagcaggcagataatctttacttgtactttacagaagaagtacctcaaatttttttgaaaagagaatctgagaacacgttgaggtacgtcataggaaaatccaattttgttcaagcgctagtggagggtaaaattaactataccaacgatatcttggagtatatcagagaattccgtttgattatggatgatatttctcagaattacaatgttaactttcaagatgcaggggtcaaaagtgctgtcgattcgtataaaaactacctaggtgaatacggcgaactggctgaattagaaccagctcacccgtcagagagccttttgagatcgttgagcgaagtaacatcatttgtgaacgagaatgcaccaaaggtattgccaccagacgctgttgagtcagaacaagatacgaacagcgatcatatcggtacttctggagatttgcgcaataaactcaaagagattctatctaagctgaatattttttcatctagaaaagatttggtctcattagagaagagattccgctcttgtgaaagtcaagtcagtctcctggagaatgaattaaagcaaaaaatggactataagaaattattagatgaaactgaagatgaaggaactaattctactgcaggaaatctgactgagcttttagaactaatgggatcacaatcctattgtcttgacgacatactggacaactatgtgtacactatatgctttcaacgtccaatgaccgaaggtgtcatatatcaagctgaggataaggttgacggtaaaaaagttttgatcggtcgttttaagacatcaggttttaatgttgacttaaacatggaaaaatacgcagaacatttaaaggccacatatgatgagaagagtgatttgatttcaaacttagcagctatacaggacgatgacggtaacatgcaacattacgtattcgggaacttaaacgaactgaataatggtctggtactagaatacgaaaatggagaccagtgctggaatggtccgcgcagatcggctactgtatttgttcggtgcagcgacaaattcaagattcggagtgtacatgaagcgactaagtgcaactacatcttcgatgtcgttggtcctctaggctgcaacaagactttcgaatacgagccccctaagttcaatttaagtgaatgactggaaaatgagtagttaggcttttttagtaagtaaacaactaggaaggccgatgctgtgccgtgatactcttttccgcaacaaaagcaatatttccctcggccaaaacgcgaaaagacgataaataagtatatcgttccaaatactgatagttctgtacgacctgttggaataacgcgaaaagaagggtacggcgtaatcaccccacacggcttgtatttttttcggagaactaagtcatagacgtaatgctaatttttccgtctagccgatgtttatgcggcttttatttttttttttttttttttctcatctttgttcttccggtttccaagatgtctcacagattattacagtgaattccaaaatcatgtttactactggaatttgtatgcatatgttttggcaatcttaagcctacggattttaaatgtgatggatataacgaacagtgtttactggagactcacttctctgggcttgagtttacgatgtatagtcatataaaaatgaagaaatttcttgagtgacaattgccgccgtacttcgtattgtcttttcttgacagtgagggcgtataagatacatcgtacatacatagagactcatttagtgatgcttgaatcgagcagtgataagataaagtttgcgcctattaaagaggtagattacaaaaaaccggtaagtaagagtaagaactatactcttattaatgacatccaaccattggagtggtattgtcacaatgatagtgaaacgggctaccaacacaccataagtaacaagacagatggtggtagaggtttattcagagtgatgaaaaaatcgatggagaccagagtcgagacccaaacgttatatttcacagatttgcatacaggcttgtgtggatttgttcaattactgtattctacggttatgggtggtatctataaaggcttccaattgaatttcaaggtttttggctcagaaagtaataatactgactacgacgtttgggaaagttttaaattggatgacatagctgaatttcaaccattaaagtttgtctctagaaatgttatttttgaatttttgagcaacaaaaatgaaaaattaggttccattggccagttatctatcaaatgtgatttaccaacatgtaacaatacaattcaaaatttgaaaatcgatttgttggtggatttgtttcaaggttttaagatgaaccccaacggttgcaattattattttgacaaacaaatctcgatgagtgacgaattcgtttcctcagacaaaatgatcagacatgtttttgtgcccagaggtaaatgtaatggtaatatttcctacgataaaaaactcaatagtggggactttcaaaataaaaatatttcattaactgatgttcctgtcgtttatctggacgctgttcaaggtcttttgccgaataaagcagccagtaaatggaatttcctatgttttcagagcgaaaactactctgttttagcaattgaattcactactcctcgagatcatgataacgtcaccgtaacagtttggtcaattactgaaaaaaacaaactgatatctattggttcttctgtgcagagcccaaaacgtcatgttaggttccgtgctacgagtacagataaggaaagcggctgggtatatccaacctctatcaagttccccggtggattttcagaacacgacttgaggctggttaatcgatacgacgttctcggtgagttaccaagcatggtcaggtcgttagctcagaaaattgtgagcatcaaacctttcatttatcaatactgtcaaccttctaaatataagcacgagaaaggtatttctatcgttgagagcaccttcattagttgaacaaaagcgtgaacacttccacatgaaattcgttttttgtccttttttttctcttctttttctctcctgtttcttctaccaactttacctaataattaatgtgtaatcgaatttttttacataatcactacctaataactaatttatcatcacttttttttttcattttgaggccacactttcccccatggactattgcatcattgcgccatgcttcttacttgcgtaagccatagaacggaaatatcatgttccccttgccgcatgcatattgaaaacatcacgggaacgagaagaatggcattttcgaaataaaaagaaatcatatttcaaatgttggggagagaaagcaaaggggaatcaataatcattaagggaagtcgatgaaagtttccttttccgaactctacctcgccttatataaaaccttggtctaaacggataaaccgagatgtagttgagtttgtgaatccagttcttgtccttcttcctctttcaaaaagtgaagcaatcagttgagagtgtagctatagaggtgtgtactctagaaatcagactttcatagcaagcagactttttttttgttgaatcttactagcggattttttagagttttcttcttcggactaatctgtcaatggttccagtaagattaatgagtcaaaagccctctataattgtatcgagaaatttcttaaaagaaggaatataattattgcggtcactagaaagttataagaaggttaccatttaactgaacagcagcggtatagtacggaataaaaaagtcttttaaaatgttgcttagtgcgcctgttaacagtaccgtgcggcgcaagccacacagtccaaataaaaaaaagccaaaagagacaggtacagctgcttccttttcgtcgtcctcttcaactgtcgtcctttcatccaataatgatggcagctttgatgctctttgggacccctctataagtaaggcctcggattttgagagtagctatattagtgctaaacgattaaaaccagaaagtagtaatagacagaaaaaaaaaaattcttataaatattctagggaggaaaacaccaacgaggtagaggaaaagacgtctcttggcagcagctctaagacagaagcagataatatatttaatgaccagctcacgtcagctggcaatactacatatgtcagtaataagcgcgatgtaaacttcggggcgaattcggctgtagtactgctcggtttgccaacaagtaaaagtgaatctcaccgacaataccacagtccttcggcttcaacaactaatgaagatgaagaggacattggtgttgatattttagtagacaaccacatcgatagttgcgaaacagtatcgataaataataatagaggtattacacaccaatatccagaaacggaatcagatgtcgactttgatgaggccgtgatattgacaccaatggatggtacggataagggagtgaaaaatccaagaccactcgaaaaaaaatatagtagcagttgttttgaggaccgtacgccccttaacttggatgatggtcatttcagtgaatgcaatcatttttctacattagatgtgtctagcttttttcatctcaacgagcatgtgcataaaatcgacgaagtagagctcgatggacctgatcgcacctttagtctagacaacgtcgctattaatacaaggaaaaaggatattgattgcctctataatagttcaagagaagacttatccaacctcacatgttcttcggaaggcccaaggaatgatagttatgatagtgattacaacattgatgaggtcacttatagagatgatgaatcaacagatgaagacgagagcttaccaaccccagatcgaaaaaggaagaaaattggccataaagcttgcgaaatattggattctaaaagaattggaataaaagtaccaaagttatacgtttggtctttaagtgataaaccgtttagtgttatcgatgggttgtgcacaaaatcgctgtacccattgagtgatgacataaatactcctgaaagtttgagctcatgctcaagctcagtaagttcacgggaaaatcaaaaaggagatgcaacatttgataatgatgctatgatagccgaccttctaaacataggcggactcgaagtagagaaggcatccaatggccatattgagctcataggcgagtgattatttgatattccagaagaatcattatcgtcttttaaaggaaaatatgatcgtttgcgaaaaaatagaagcactttactacttgaattgtcatagaatagtaggaaaacctacttagtcagcgaagatcaacttggaatatcgtatgatgagatggagaaaaatttaggggccgaaatggatggatccacttgagagaggatcaaggaatactgaagtgcagctgacgatccagtcagcgacatctgtctttttttaattactattgctgtgtacttatagagtcggtggcatttattttatttttagtatttttttatacgtgcgtattctattgttcatttttttaccaattttttttttatttttatattttgtttcttgcgtggagtttttacaggaagttaatcacaacagagggttcaatctccaaggcataaaataaacaaaaattgtaatagttagcaactgcaatacgaattaaaatttgaggaaaaatctagtattgttcacacgagccaatgctctgaagtttcgaaagctaataaatatcatgtggaaacttttctgagtcattaataagcaacactatttattcttcttataattagtcttacaagtaaactgccttgccgcataagcgcattccctctatgagaccatttgtaatttcgagaacacaattttacaaccgagtaaatatcttataatcattaaaattattaaactattatacaattttttttactttactttaatttttatatacccatataaataataatattaattataaccaaaggaagtgatttcattatgcttgagtagaggaagagtacttggtaacagctctagtaccttcagagacagcatgcttagccaattcacctggtaagatcaatctaacagcggtttgaatttctctagcagagatagtagacttcttgttatacgcagccaatttagaagcttcagtagcgattctttcaaagatatcgttaacgaaagagttcaagatagacatggacttttgggaaataccagtgtcagggtgagtttgcttcaaaactttgtaaatgtaagaagagtatgtttcctttctagccttgcttctcttcttaccatcagtggaagtggaagtctttttagcggctggtttcttttcagctggggctttggaggctggtttcttttcggctttagcagacattgtatgtgtgtatggtttatttgtggtttgacttgtctatataggataaatttaatataacaataatcgaaaatgcggaaagagaaacgtctttaataaatctgaccatctgagatgatcaaatcatgttgtttatatacatcaagaaaacagagatgcccctttcttaccaatcgttacaagataaccaaccaaggtagtatttgccactactaaggccaattctcttgattttaaatccatcgttctcattttttcgcggaagaaagggtgcaacgcgcgaaaaagtgagaacagccttccctttcgggcgacattgagcgtctaaccatagttaacgacccaaccgcgttttcttcaaatttgaactcgccgagctcacaaataattcattagcgctgttccaaaattttcgcctcactgtgcgaagctattggaatggagtgtatttggtggctcaaaaaaagagcacaatagttaactcgtcgttgttgaagaaacgcccgtagagatatgtggtttctcatgctgttatttgttattgcccactttgttgatttcaaaatcttttctcacccccttccccgttcacgaagccagccagtggatcgtaaatactagcaataagtcttgacctaaaaaatatataaataagactcctaatcagcttgtagattttctggtcttgttgaaccatcatctatttacttccaatctgtacttctcttcttgatactacatcatcatacggatttggttatttctcagtgaataaacaacttcaaaacaaacaaatttcatacatataaaatataaaatgtccggtggtaaaggtggtaaagctggttcagctgctaaagcttctcaatctagatctgctaaggctggtttgacattcccagtcggtagagtgcacagattgctaagaagaggtaactacgcccaaagaattggttctggtgctccagtctacttgactgctgtcttggaatatttggccgctgaaattttagaattagctggtaatgctgctagggataacaagaagaccagaattattccaagacatttgcaattggctatcagaaatgatgacgaattgaacaagctattgggtaacgttaccattgcccaaggtggtgttttgccaaacatccatcaaaacttgttgccaaagaagtctgccaaggctaccaaggcttctcaagaattataagatcggttctggtattttaaagaaggcggaaggaactaaactgcttctccattgtaactatattaagtgtctattagacctttctgtttttcctttttatttttctatatataatttattgggtatataattaacggtaacatatgtcatgcatgatataaattttttgttgtgtcttcctgttttctctgttgctctgtttaggttcattgggcactgttgcttacttgaacatgattgagtagcaaacacattctgtgctttgttcactttgatagtgtgacgaaattttcacaaccaaaggaaaaaagctcacgattgcgcgatcctgtcacggagaactgtccgcagcagcccgcggcttctgtccttattcgcccatttttttttgattttcgactttttcactctggctagttttattacgcatatttgtatatatatatacgcataaatttctgaaatggattacctggtttatcagaaacgagagctttaataaagaaacattaacgtttctctggtaaagtcaccacacagcatcaaatataacagtaatgtctagctcagaatccattagaatggtcctaattggcccacctggtgccggtaaaggtactcaagctccaaatttgcaagagcgtttccatgccgctcacttggccactggtgacatgttgagatctcaaatcgcaaagggcactcaattaggtttggaagcaaagaaaattatggaccaaggtggtttagtctctgatgacattatggttaacatgatcaaggatgaattgaccaacaatccagcttgtaagaatgggttcatcttggacggtttcccaagaaccattcctcaggctgaaaaattggaccaaatgttgaaagaacaaggaactcctttggaaaaagccatcgaattgaaggttgatgatgaattgttggttgccagaattaccggtagattaattcacccagcctctggcagatcctaccacaagatctttaacccaccaaaggaagacatgaaggatgacgtcaccggtgaagctttagttcaaagatctgatgacaatgcagacgccttgaagaagagattagctgcttaccatgctcaaaccgaaccaattgttgacttttacaaaaagaccggtatctgggctggtgttgatgcttcccaacctcctgctactgtttgggctgacatcttgaacaagctaggtaaggattaatgaccttgcgcaatgtcttctaaatatcttttcttttttttaaattaatgaaaatataataaatttttgtatgtgagtacatatatccgcagtatactataaatgaaataataacataagtgtttgtaactggctataacgtccttaaacatgtgcactgccattaagtacttagtcaatatttttatcgttgagaacgaacgcaaatcatattactaaatagatgaacaaaagcgcatcacataaacaaaaacggtataacagtaatagtgaagctttttataaacctataacgaaataagcgcttttcaggttttataattcagtcagagttctaactggacatcgttttgcaggggataaaaaaaaaaaggaagcttcaacccacaataccaaaaaagcgaagaaaacagccaatgccaaatgacaataagacacccaataggtccagcactcccaagtttactaaaaaaccagtaaccccgaatgataaaattcctgaaagagaagaaaaatccaatgaagtgaagacacctaaaattccattattcacgtttgccaaaagcaaaaactattcaaggccgtcaaccgcaattcatacctcacctcatcaaccaagtgatgtaaaaccgacttcccataaacagttgcaacagccaaaatcctcaccactgaaaaaaaataactataattcttttcctcactcaaatctggaaaaaataagcaacagcaaactactctcccttcttcggtccaaaacgtcagcaggaagaattgaatcaaacaatccttcacatgatgctagcaggtctctagcaagttttgaacaaacagcattttcccggcatgcgcagcaacaaacttctaccttcaattcaaagcctgtacgtaccatagtaccgatatcaacatcacaaaccaataactcatttttatcaggagtaaaaagcttactaagtgaagagaaaataagggattactctaaagagattctaggcataaacttggcaaacgaacagcctgttttagagaagccacttaaaaaaggatcagcagacatcggcgcctctgtgatttctttgaccaaggacaaatctatcaggaaagataccgtagaagaaaaaaaagaagaaaagttgaatataggtaaaaactttgcccattctgattcactatcagttccgaaggttagtgccggtgacagtggtatatcaccggaggagagcaaggcaagaagtcctggaattgcaaaaccgaatgccatacaaacagaagtgtatggaataaatgaggaatctactaacgagcgtttagaaataaatcaagaaaaaccagtaaaattagatgagaatagtgcaaatagtacggtcgcatcggccttagataccaatgggacgtcagccacgacagaaactctaacatcaaagaagatcgttccatctccaaaaaaagtcgccattgatcaagataaaataacactgcacgatgagaaaacacttgcaccttcgaagcatcagcctataacatctgaacaaaaaatgaaggaagacgccgacctcaagaggatggaaatcttaaagtcacctcatttgtcgaaaagtccagctgacagacctcaagggcgtagaaacagccgaaatttttccactagagatgaagaaactacaaaacttgcttttcttgttgaatatgaaggccaagaaaacaactataactctacttctcgaagcacagaaaagaaaaatgatatgaacacttctgcaaagaataaaaatggtgaaaacaagaaaattggtaagaggccgcctgaaatcatgagcactgaagctcacgtaaacaaagtaaccgaagaaaccacaaagcagatacagagtgtacgaatagatggtcgaaaagtgcttcaaaaagtacaaggagaatcccacattgattcgagaaacaataccctgaatgttacaccatcaaagaggccccagctaggagaaataccgaatcctatgaaaaagcataagcctaatgaagggcgaactccaaatatctcaaacggtacaataaacatccaaaagaaattagagcctaaggaaattgtgcgagatattttgcatacgaaagaatcatcaaatgaggctaagaaaactattcaaaaccctttaaataaatcacaaaacactgctcttccttccacacataaagttacacaaaaaaaagatataaaaattggaactaatgacctttttcaggttgaatctgctccaaaaatatcctcagagattgaccgggagaatgttaaatcaaaggatgaaccggtttccaaggctgttgaaagcaaatctttattaaatttgttttcaaacgtactcaaggctcctttcattaaaagtgaaagcaaacctttttctagtgatgctctgtcaaaagaaaaagccaattttttggaaactatcgcttccactgaaaagccagaaaataagactgataaggtgtctctatctcagccagttagtgcaagtaagcatgagtatagcgataattttccagtttctctatctcaaccttcaaagaaatctttcgcaaatcatacagaggatgagcaaattgaaaaaaagaagatctgccgtgggagaatgaatacgataataactcacccgggaaaaatggagctggtatacgtgtccgactcagacgattcttcttcagataatgatagcctaactgacttggaaagtttaagctctggtgaatcaaatgaaatcaaagtaactaatgatttagatacaagtgctgaaaaggaccaaattcaggcaggcaaatggtttgatcctgtattggattggcgaaaatctgatcgtgaattgacgaaaaacattctttggaggatagctgataaaacgacatacgataaagaaacaataactgaccttattgaacaagggatcccaaaacatagttatttaagtggcaatccattaactagtgtgactaacgacatttgctctgttgaaaactatgaaacatcaagtgctttcttttaccaacaagtgcacaagaaggacagattacaatatttgccattatatgcagtttctacatttgaaaacacaaataacactgaaaaaaatgatgtgaccaataaaaatatcaatatagggaaacatagccaagaacaaaattcttcttccgctaaaccatcccaaattccaaccgtgtcttctccattaggattcgaagaaacaaagctaagtaccacgcctactaaaagcaatagaagagtgtcgcatagtgatactaattctagcaaacccaaaaacacgaaggagaacctttcaaaaagctcttggaggcaagaatggcttgcaaatttgaaacttatttccgtttcgttggttgatgagttcccttcggagctttccgacagtgatagacaaataattaacgaaaaaatgcagttacttaaagatatatttgctaacaaccttaaatcagcaatttccaataattttagagagagtgacatcattatactgaaaggtgaaatagaagattacccaatgagttctgaaattaagatttactacaacgaattacagaacaagcctgatgcaaaaaaagccagattttggtcatttatgaagactcagagatttgtttccaacatgggatttgatattcagaagtcctgtgaacctgtttctatatccacgtcggtcaaaccacatgtggtcgagcccgagcatatggcagatgccaaaattatgcctaaggatatactgcaaattacaaaaaaaccgttaatggttaaaaatgtgaagccttcttctccgccagatgtgaagtctttggtgcagctgagcacaatggaaacgaaaaccctaccagaaaagaagcaattcgacagtatttttaattctaacaaagcaaaaataatccctggaaatgggaagcacgcatcagaaaacatctcactctctttctcaagacctgcgtcctacggctatttttctgttggaaaaagggttccaatcgttgaagatcgtcgagtgaaacaactcgacgatataacagacagtaatacaacagaaattttaactagtgttgacgttttaggaacacattcacaaactggtactcaacaatcaaatatgtacacatcaacccaaaaaacagaacttgaaattgataataaggatagtgtcaccgaatgttcgaaggacatgaaagaagatggtctttcctttgtggatatcgttttgtcgaaagcagcatcggcgctggatgaaaaggaaaaacaattggctgttgcaaatgaaattattcggtctttgtcagatgaagttatgaggaatgaaattagaataacttcacttcaaggtgatttaacttttacaaagaaatgtcttgaaaatgcgagaagtcaaatatctgaaaaagatgctaaaattaacaaattgatggaaaaagattttcaagtgaataaggagataaaaccgtattgactttttatcattctacaaaagaccagtaacgaagtgtaccctgtttttctttgtcgttttcttctataatgaacaatttactttacggtctttaatcgattttaatgattagttgggcttttggctacatatgtaaaattacatataatataatggacacataagcaaaaaaaaaaaaaaaaaaaataaacaaatgagcaacccatcaaataccaagaacaaagaatttaatataatatatagttattaaatttaaatgtatatatgcagttctgctcttattttgtgaccaatttctttaagtcatccaaaccgaccttgccactattagatttgcttgaattttgcgacgtttcatgataacatgtcgagtggaaatatttgccattcacttcaatagtatttttccaaacccattcaccagattcttcatcataaacgccagtaacggtttccttacaaattggacatttgaaggccatatcttgtgaagtttctggtacaacaacatattttccccgtatttccaactcgttacttctatcacttcctaaagtgttgtctacagagccttcgtcattttcatcagcgtgaatatttagggcacttttatcgatatttttattggcatgcggatcagtataatcatttttatgctttgtggaggtaatttcatcatctttgaaggctgcccattgagagtcactcaaataccagtttcttgattgaatatttttccttgtggtagttgtatttaagttagagttgcttatgcctgtatttgctgtgttttgtgatcccttaattcttgtatttattctgaaatgccagtccaaatgctcattttgtagtagtttttcactttctgagttgccaaatctcttaccacacacgctacatttatttggcttggatcggtataataagtgaataagattattttggacgatgggattttcttgaagaagagtttgttcggacagctgcagggatgggttattcaaaacgtcgatgttaaccgtggcaaaataagctttgcagtcagaaagaatatcatttaataagggtatctttggcaggttcttcatcaattgtttttcgtgtgaatcaagagagtagtttgagtgtccatttagctttttataaagcgttacgatggattcttttggtggagtatatatgagcccttcagccttaagagatgcatagaggttattgattttgtttagggacttttttttctcaatttcttgaaaagattcaacgccagaaatattaccaaaaagagaggaagataaagaattctgttggttcgttgtatctgaattatttccaaacaatggaatcgctgaattagagttttgtgtgtaagaaccgaccatatccttagtttcgtgatactgctgctgctgctgctgttgttgttgttgctgttgctgctgttgttgctgttgctgctgaagttcgtgatacctcattctttcctgcaaaacttgttggtcctgtgagaagacctgccttagttgcatttgaacttgtttcagagcattgagagttagtttttctcttttcagttcttgtttcaactgagataaaaccaacagtttcatttttaatttttcatcatttggttgattctttagcctttcactagttaaacaagttaatttatcaatgtctcttaataggaggggaacagtcggagttggtaacattgcttgcaggtttttctggtggagagcactggcctttattaaaaactgttcaattttctccagtgctgagccttcaaacagaggcaggccggtgtcattaggattcaaccaaagcttaaacatattgatgagttttgttcttgtggtgttgtccaccaataagtatgttcttttgtacaagttaaacaaatttctactgaagtagattgtgtatgggctgccaacattcttacaaatggagtccaaggcataaaaagcgtatagcttctgcttaggcatacatttttcaattctactctcaatggcgtcaacaaaatattgagcacacgaaatgttttcttctgctaacttcgtgagagtggtaataatgggtctcgagttaaaagttaattcttcaagaatactgttgaaatccttgactataacttctgtgtcgtgatccataatgaaaagagagtattacaaatagacctagtgttttcaagtacagttttcttaactgctccgaaaattgtcctggtaattctttgcaatgcaaaattgaaagagagacttttaaactactaaacccttaacagtagaacaacattgtctcattaatttttgaaatttcgctttcttcccatgccttaggccaagttctcatccaatgcgtcgagtccttaaaaaaaattcgcccgggtaaactaaaacttagatgcactaggtaataccatttggtgataaagggaataaaaagcagcaaatcctagctcaattacgaaactctgatcacttggggcccagcttcattggctaaattggtgtatcccttgaaccgactacgtaagtacgttttgaaaagtgtgtaaatctatgtataaaagtacatcaaaaattagactgagaaagttctgtatagctgtactaatacattaggaataggctagacttcttcgccgctggaataaaacagctgggccttctcttcattggtaccacttgctttgctctattgaaagtacaaagaatagagcagacgagtgtaaacatcctatctgcgttccaacagaagtgcgtattgaagtcatctcatgctaatggccatctcatgtagaatagtaaggaaaaacgtatctaatttataaaaacttgagttagatctcaaacttcggtagattgcgccttatttaacggatgatatacacttattctactgctcacattactcgttttacaggaaaaaatggtcaatgcgggcaaaagaaaaaaatattgggcgatatgttacaagaaaagggtgagatggaaatttatgctaaacattaagtggaaaaaaaccatatccatacaatagaagtatatattctgaataaagggtcaattaaatttcaccaaggaataaaatattgttaaagaaagtaacaggaagagaaatcggatatgcctgacaataatacggagcaattgcagggatctccttcaagtgaccagagactgagggttgactgggacaacggtaaccattttgacgtctctcccgacagatacgcgcctcatctatctgaattttacccaattgtaaatagtaaaagaccagtggctagcagtgctggctcagaaaataacgaccatctggacgacatgaaccatttacgttcatccaaagtgtattcaaaggcccgtcgggcatcgagcataacttctggtacgagcacaataaacgacttgcaaacgctaatcacaaagagagatgtgaaagagacccaggaagccctatcgacattactcaggaactcgaatgcttattcggattcgttattaaagacatctcagaatggggcagaaattgcccattccttagaaaacattgccaagttgaagggttgcaatgatgaaacggcggagaaactattgagtgccagtgggttattctaccttttatctaatcatcagcttataatgtcaaagtatttcaatgacttgttgggagataatttaattgatgatattgatgaattcgaattacagaccaagataatggagaacaagttcaaagcacaaagcaaagagcaaagtttaaaattgaaattgcaggaaagacataacttcgatatctcgaaaagaaaaataaggaatttaatctcataccgagagagcctttctagcttgcaagcaaggttagatcaactggagacactaaagcacgatttttacatggattcatacgaacttgtggaaaatacatgcaacaaagtactcagcaaagttgccacggtatctagggcacaagtggaaatttctgaaaatattgcaaggaaaggttggtctggaggcgggctagacgaactactttgtgatgcagacgaccccttcagcaaaaaagcagatgggccatacgggaccatcggtggtgatggagagactgctggagaagcatacaacagcgatgaggaaacgggtgggaatgacgtggtgctcaatgaactactagaaggaaccagccaaccttccacatcaaaaacatctttacccaaatccaaggggtcctcaacggtatccacaccgaatcattcacagtcaagttcaaacaaggacggggtacgaaacaatggcggcggcaaaaatggcgaagatgaggatacagacaatttgatgggaacagaaaattcattttctttaccgcctacgagaaactctgccgaggaaaccacacaaacgtttaaacaattgtccattaaagaagataatgacaatcacagcagcgatacggacggcatgcaagaccagtcaagtaatatataaaatttgtaactctatgtatgctttttatatagaaatggagaaagtgaacaattgaagttatagtattttcggagaaatgttgcatatatacataggaaaacggttaaaaggccctgcttctaccttctgtttccccctcgttcttttcaccagaacttgtaccatttcttctcagaggaggcctgagataaattctggttactttgttcaaactgactctgcttttcatttttggcggcctcccattgccccggcagagatgggtcatgagggacattatggagcattggtttttcctttttcgccacggtttcctttgccaattgtgcgatctggaaacttttttgtctctttagcctacattgctcccatccgacaatcgagcccagtatcagagagctcatcgcccaattcgtggccttagtcgggctcttatggtatataaatataatagatcccatcaagaacatgctggaaaacccgagcatgcccgcgtctctgaagcacgggattgaagtcagcttctgcaaactaaaatcactccatctgatcgagtcccaagcctctttcaaagtagcccgttcttgcttcttggccaactgagaattggacaagtcatcggcaaacttgggtggagtgtcttctaagaggatcttttgaccccgcgagtaatttgtcagcacgcgatcaccatctgctttaccctgcggttgttgctgctgcttttgatcttctgtctgatttgaccacggccaccaacgcatctttatattaactgttgagctgctcgttacgcactgctgtggacttcactacaatgctttaccgagcagtggagtttgatatagtggtggtacccccgacggtgctataataagcttgcctgcacggcttaccctaccgctcggaaaggccgccttcgtcgctcattggtctgcggccgcgggcgctttttggtcattgttcatatatgaagaaagagcaggaacggaaatttttcatcttgccttgcccattgttctgatccatgcgttgttagaaatacaacgtttgcatcataccaaacttctccattccgtcagctgatactctattcggttgtgtgttgcaccctgctctgctgtctctcaaccgttcttcctttacacgccttcccttctcagctcgcgtttcttttttttttatcccactcttttcttttttctttcctatatattgcccatataagtttggttggaaggaaaactaatagagctagttgttgtccctcaataatcataacagtacttaggtttttttttcagtatgcaacgctccatttttgcgaggttcggtaactcctctgccgctgtttccacactgaataggctgtccacgacagccgcaccacatgcgaaaaatggctatgccaccgctactggtgctggtgccgctgctgccactgccacagcgtcatcaacacatgcagcagcagcagcagccgctgctgccaaccattccacccaggagtcgggtttcgattacgaaggcctgatagattccgaactgcagaagaaaagacttgacaaatcgtacagatatttcaacaatatcaaccgattggccaaggagttccccctagctcatcgccagagagaggcggacaaggtcaccgtttggtgttccaacgactatttagcactttccaagcaccctgaggtattggacgccatgcataaaactatcgacaagtatggttgtggtgccggtggtacaagaaacattgctggccataacatccccactttgaatctggaagccgaattggccactttacacaagaaggaaggtgccttagttttttcgtcatgttacgtagccaacgatgccgtcttatccctactgggtcaaaagatgaaggacttggtgattttctccgacgaactcaaccatgcgtccatgattgtcggtattaagcatgctaacgtaaaaaaacacattttcaaacataatgacttgaacgaattggaacaactgctccagtcataccccaaatccgttcctaaactaattgctttcgaatcagtatattctatggccggttcagtggccgacatagaaaaaatttgcgacttggccgacaaatacggtgctttgaccttcttggatgaagtacatgcggtcggcctgtacggccctcacggtgcaggtgttgcagaacattgtgattttgaaagtcaccgtgcaagtggtattgctaccccaaagaccaatgacaagggcggcgcgaagactgtgatggaccgtgtcgacatgatcaccggcactttaggtaagtctttcggtagcgtaggtggctacgtcgcagcctctaggaaattgatcgattggttcagatcgtttgcacctggtttcattttcaccacgactttaccaccttcagttatggcaggcgctaccgcagcaattagataccaacgttgccacatcgacctaagaacctcgcaacagaaacataccatgtacgtaaagaaagctttccatgagttgggcattccagttattccaaatccttctcatatcgtcccagtgttgattggtaatgctgatttggctaagcaagcttctgacatcttaatcaataagcatcaaatctacgtacaagctatcaacttccctacggttgctcgcggtaccgaaagattgagaattaccccaacgccaggtcacaccaacgatttatctgacatcttaatcaatgcagttgatgatgtgttcaatgagctacagttaccacgtgtcagagactgggaaagccaaggtggcttattgggtgttggagagagcggatttgtggaagagtctaacttatggacatcaagccaactatctttaactaatgacgacttgaaccctaatgttagagaccccatcgttaaacaactagaggtttctagtggtatcaagcagtaaaacaaccaatatatgcatgggctgagatagaggtacaaggaatttgtaaatcagtaaaaaaaaaaattaacagtttttttttttcattttttttttttattcttatttatgtatgatactttattattatttctcttaattatttatttatttaactaacacgatgagcacttttaactgcaatggttaaactgtagcaatgttggtaaaaaagcagggaaagttcaaaaataatttatgtatttttcctcgggggtacagaaagtaaagagagagaaacgtatgagtatatataggctaatgtaatatgtagtggtaaataaagagacaaaagttagctattcttgtttgaaatgaaaaaaaaaaagcactcaagcgttgtttttttccaattcattttgcaagttttttgtacttttcttcaattcattagacaattcatcgacgttaaattcttgggtagtggaaggttcgtgttgtggaacttctggcataacttgagctgaagatgtgtaagccttagactctggttccaatggaacatcagcggccaacttagaagtgctggcggtttgaggaccggcagtagaagacacaggagcagtcttagatttgaccaagttggaaattgggcccaatttagattcaaccttgtccaagtatggttttgtcttttcgcaagccatttgagaaaactcttgggtcttttgcttagaaatttctacaccttgagcgacagtagcatcaatttcatgcttgtaggaatggtagataactggcaaagtgaaggtaaaaatgtcagcaacaaagacgatggtccagatagagaaccaggagaagaatttgtgtagtagaaataaggcaacagcggtcttgaaagtgtgcttagggacttgagcgaatacagtctttcttatgtgggcttggaagactggtagctgtttcaaagcttcatcgatatgaggcttaataaagccggcgatatttggacattctttaggaccatacttggtgattaaaccttgtcccaaaaagagcttggatacgaattcaatagatcctgttgtgaataagatagtgtaggcaaccttcaaaaagaaagtgatcaagttaacttttttcaaaattaacaaggctaacagagacccaccgaaatatttaccggtttgaacagggttcctccataatagcaaatcgcaattacagcttttttgttgttgttgttgttgggcttggctatgttgagctgaggcggacatatttgcgtgtgtgaatatatattatatatatatacgcttgcgggtaggaagaaacaattaaatatttggcttgagagttgaaaagaaagagatcaagaaaagggaattgttgaataaaaatttgaaaaatgcgaagttgaagtgccatagaagagaaacagcccacacaggggagaagcccactggaaagggggcactgaccaactttaaataggaaacagaagataccacaagccagcgatacaacagcaccaaacaccgaaaagaatagccaaagctgtcctctggtgttggaaaaactggaaaaaacgcaactgcgttggctgctacggtgaaaaattttcctatgacttttttcactgcttgttcgtgcgaaattaccgcaaacccggtaaaatgtacacgtatcaagtgataaacaatttcgtgtcaagtgagcagaatggagcgatttggaaaaaaaaaatttttattgttttttcccccgggattttgctcgagatgactgaaattttgtaatcgatgagtctataccagaggcagcaaatatcaccaacatacacaggtatacacaatctcatgtccacacacacgtacagacacgcacatatatatatatatatatatatccccataggtatttatatatacaaaagaatcctcgtgtgtttgtgtgtgcaatagctagttttgcgctgcctcttatagtagacaatatcactttttcaataaaatagaacttgcaaggaaacaaaattgtatcgcttcaagatgctacgatcaaccacatttactcgttcgttccacagttctagggcctggttgaaaggtcagaacctaactgaaaaaattgttcagtcgtatgcggtcaaccttcccgagggtaaagttgtgcattctggtgactatgtatcgatcaagccggcacactgtatgtcccacgataattcgtggcctgtagctttgaaattcatggggcttggcgctaccaagatcaagaatccttcacagattgtgaccactctggaccacgatattcagaacaaatcagagaaaaatttgaccaagtacaagaacatcgaaaattttgctaagaaacaccatatagaccactaccctgccggtagaggtattggtcatcaaattatgattgaggagggctatgctttccccttgaacatgactgtcgcatctgactcgcattcaaacacctacggtggtctggggtcgctgggcactccaatagtgagaacagacgctgcagccatatgggccacgggacagacgtggtggcagatcccaccagtggctcaggttgagttgaaaggtcaattgcctcagggtgtttccggaaaagatatcattgtcgcattatgtgggcttttcaacaatgatcaagttctaaatcacgccattgaattcacgggtgactctttgaatgcattgcctatcgatcacagactcactattgctaacatgaccaccgagtggggggctctttctggtttgttccccgtggacaaaactttgatcgactggtataaaaaccgtttgcaaaagctgggcaccaataatcatccaaggattaatccaaagactatccgcgcactagaagaaaaggcgaagattccgaaagcagacaaggatgcacattatgccaagaaactgatcatcgatctagccacgctaactcactacgtctcaggtccaaatagtgttaaggtctccaacaccgtgcaagatctatctcaacaagacatcaagataaataaagcttatctagtgtcatgtacaaactcccgtctatctgatttgcaatctgcagcggatgtggtttgtcctactggagacttaaacaaagtcaacaaggtggctccaggtgtggagttctatgtcgctgctgcctcttcagaaattgaggctgatgcccgtaaatcaggcgcttgggaaaagctgctaaaggctggctgtatcccactgccttctggttgtggtccatgcatcggtctaggtgcgggattactggaaccaggtgaagttggtatcagtgccacaaacagaaacttcaaaggtagaatgggttccaaggatgcattggcttacttagcttcccctgctgtagtcgccgcttctgccgtgctgggtaagattagttctcctgctgaggtattgtccacaagcgaaattccattcagcggcgttaagactgagataattgagaatcccgtggttgaagaggaagttaacgctcaaacagaggctccaaaacaatccgttgagatattagaaggtttcccaagagagttttctggtgaattagttttatgtgatgccgataacatcaataccgatggtatatatcctggtaagtacacttatcaggatgatgtgcctaaagaaaagatggcgcaagtttgtatggaaaattatgatgccgagttcagaaccaaggttcatccaggtgatatagtggtcagtgggttcaatttcggtaccggttcctccagggaacaagcggccaccgccttattggctaaaggtatcaacttagttgtttcaggatcttttggtaatattttttcaagaaactccattaacaatgctcttctgaccttggaaatcccagcattaatcaaaaaattacgtgagaaatatcaaggtgctccaaaagaacttacaagaagaactggttggtttttgaaatgggatgtagctgatgctaaagtggtcgttaccgaaggttctttggacggccctgtgatcttggagcaaaaagtgggtgagctaggtaagaacctacaagaaattattgtaaaaggaggcttggaaggttgggtcaaatcccaactataatgtgcataaatatctagaaaaatcgcacccttttctttatttattaagtttatttatttatttacggttattcacgtatattttgttaatctattgatacacaagttcttatttgtaatttttctacttcttttcattaaatttcaaagatgctcttgtgacgtccaaaaccagtgtctgacctaaagcccgtgggaaaaacaacgtaaatttctacataaaaaagtcaagtaggcgctcgaaagagtttcagaaaatacccagctgaccattaactgaagtagcaaacatctatggataaatatactgctttgattcacgatgagaatttttcaactcttacattgaatgtctcgagataccctaaaagtttggcatattgggagaagttactgaactatatagtaaaggcttcggcaccaatatgcaagtccactgagcctcaattattaaagttaatacgatgtacttattcttctatgctgaatgagtttccctatctagaaaactactatatcgacttcgcgctactggaatacaaactagggaatgtttctatgtctcataagatatttcagcgcggattgcaagcctttaaccaaagatctttactattatggacttcatatttaaagttttgtaataacgttatctcacaccagaagcagttgtttaaaaaatatgaaacagctgaagaatatgttggtttgcattttttcagtggggaattctgggatttatacctggaacaaattagctcaagatgtacgtcttctaagaaatattggaacgttttgaggaagatactcgaaattcctttacactctttttcgaaattttatgcattatggttacagcgcatagacgatataatggacctaaagcaattatcacaactaacaagtaaagatgaattattgaagaaactcaagatagacatcaattacagtggaagaaagggaccgtacctgcaggatgcaaagaaaaagttgaagaaaataacgaaggaaatgtacatggttgtacaatatcaagtacttgaaatctattccatttttgaatcaaaaatttatatcaactattatacatcgccagaaaccttggtttcttcagatgaaatagaaacatggataaaatacttggattataccatcaccttacaaacagattctttaacacatttaaattttcaaagagctttacttcctctggcccattatgatcttgtatggataaaatacagtaaatggttgataaattcaaaaaatgaccttttgggggcaaaaaacgttctattaatgggtcttaaattttctttgaagaagaccgaaataataaaactactgtattcagttatttgcaagttaaatgagtacgtacttttgcgaaatctattggaaaaaattgagtcctcatattccgacaatgttgaaaacgttgatgattttgagatattttgggactatcttcagttcaaaacgttctgccagaattctctgtattccagtcgatattctgattcacaatcaaacgggcttttgaataaggagctgtttgataaagtatggaaacgtttgagttgtaaagaaaaaaaaagtggtcaagaaattttattgaataacttagtacagttttattcgaaggataccgtagaatttgtagaaaagaacatatttcaaaagataatagaatttggttgggagtactacctacagaacggtatgttctggaactgttattgccgtttaatttatttcgacacttctaggtcatatttggacaagaggcaatatattgtcagaaaaatatggccccaaatagacaaaaaatttgcacagagcgtcttgccgtctttaacagaattctgtgagtcatacttcccagaggagatggatacattagaggaaatgtttactgaagaaccttagccaaaaggcattgtcatttattaaaaggtataaatatgtaaatgtatacttaatgaccgttaagaaaaactactagcctcatcactcccgcagatctctataattgttgtttgaatacttgatacggtggagtggcaaggacagtctgcgcagtcctaatatcgatattgatgtcttcgatcagagcttccttagtagtgtagttcaattcgggtctgatatgacctaaaatattgaacttgaccctggccccataaaaatcatttttaaaatcatgtataatatgtaattccatggttttgaaatcatttccgtagaatggatttttcccaactgaaagtaccataggaagtacggacaaatcatcgttcgcttcacttaaatattgaccgtaattataaaccacagttcttccatcccgccttgtttccaccgatagttcttgaccatcaacagttttaatgtgagcaaacccaaagtaaacccctaaatccaaatcgttgatacctttaggtaactgatttataggtacattggcagtgggaatacccaattcggcggatccgcggccaaatccacatacaatgtcacaatagtcagtaacaagcgggaatggtggacctggttgcgcaggtattggcaaatcgacttctcgtttaaaagtatcaattatatctgtattcgtatttcggttcattaagaaagtacctgctaacactagcaataacgaaacataaatagtccacgtaaacatcaacacttcaacaacacgtgtctgtgaccgcttcacgggtccaaattaccactttctagaacattgtcttgtacgtccaataatagtgttaccaatgctgacagagtattaaagcaacgatttgaattgacgcattaccctcctgcataaaggactacaaatacatcctctcttataacgcaattgcaacatctgaagtgcagtgtgatcaagatattcaattctctattagagtaacttaatcatgtttcacatgatcagtattcattgtaaaacctcttgagtgtgattcgttgccaactaacataagcgtgcggattctttagaaagtgggtgtgccgaccctgggaaagattgcataatgtgaatccttaatgacttacccatactcttcattaataacctatttagaaaaagaagaaaggctgtttcggagctccttttgtgctgtttgcaaactgtctattttcgcatcaagttttacccatctactactttattcgctttacggtaaaagcgaacacgacaaaatcacctatcatctacgaagggcctttcgaaaacagaagaataaaaagacaggaaaagcatctgtttagaattttataactaatttggggaggtatctgtaaagtaatagacaggaccggaaatagtgtaaatactctcctttgtttttttagttgtaccactttgaagagggctcgagattcacgaacaaaatgcaaaggttttcactagtcactcacagatcattctctcactcctgtgtgaagcccaaatctgcatgctctttggtcaaaccagttcatcacttggtgaaaattgataagtcaaagttatcccctagatttccagaattgaaatatgacaaaagtgatattaggtcacctggatttaaaccaaaagacactcatgcagatagactcaatgaccattaccttaacactttacaatctgatttgttattgattaattattcacataacgctgcggtggtaaagggtctaaaacaaagagcgtggagtggtgattcgccataccacttgaacagaccaccgaaaaatcctcgaggttcgaaagctcaactacctgacattcatcctatcaaatggagtaacattcctgggctagaaagtgttgtaataaactgttttgttagggaagcgagagaaaatcagctattggctatcaccgctgcgttacaattacaacaaattactggatgtaaacctcatccaattttttccaaaaatgatgttccaacctggaaactgagaaaaggtcatcagatgggagctaaagtcgaactaaagggaaaagaaatgtctcagttcttaagcacattgaccgaaatcgtcctaccaagaatcagagaatataaaggtataagcaaccagtctgggaacagatttggtgggattagtttcggcctgacggctgaagatatcaaattcttccctgaaatcgatgcaaaccaggactcatggcctaaaacttttggtatgcacataaatataaacacctcagctcaattagattaccaggcgagaactttgttgagtgggttccagttcccatttttcggagaggagaaataagaatacaatctcatggtcctggccagttagccatgctctatggcagaaaggcaaagggcatatataatttcccattcgtcatgtaaatatataaactgtacaagatactatctctctccatttttcaatcatatagttctctttggggcactgagatgtctacaaattgttataaaattggacgtctcttacacaactcacaactcaactctgtataaagatttttaggaaagaaaatgtacataaaagtgaatacttgtttaaaaatgagaacaaagattcctacgcaattaaaatctatttaaagattttccttatttttttatttcttttcgaattttttaagttttattcttatctcctttgacattataacttacattgcatcagctcagggtggttcaaacatgagtgagagcaagtttattggtcttcttagcaatcaatgccactctgtcacctagggacagagccaaaccttgtccctttgatcggatacgaacataacctatgacatcattggttttggaatccttttcgatacacaagttggctagggcatcttcaccaaaggacgacttcgcatacagattacaacttaagaacctacaatcatcttctcccaacgactctgatggtgttagaatacccatattagttcccttgaccagttctctcaaataagcatgcaatgttggtagttgtgatttgaccgatattttgttctcccactcaaatgcattccacatggtacggaaatgttcatcgtcagcagtggctggtttgatataatccataatgtcaacatgaacgtcgtttaaaataacataacgagcatcttcaccatgcgcaccatcataaataatattaccgaaaatgacacctgtgtcagcagaggaaactttgacagtaacagtgaatttgtggaagccatgaggaatcacgttggtcttctgtggtgtgtcaataatcttcaaatcaccaagagttgcaaattgcacatgtaggtttttcaatgtttctttcgtttgattaacaagaagaacatctaatacgacgtcaaattgattgtttgtaatacaagcctcggcgtaaactggatcagaaaagccacataaaggtactatcttcttcagcttcgaaatactagagctgctagtagcgtggattgcatctcctttcattgccagttgtaaatcttcttcaatactatctttttgcacattagtagaatccacaccagcaaattgcctgaaagaaatcggcgtatcaattggttcgatgtttttgcaactgtcttttaatgctctcttatgcttgttcttctttgcaatttcaatttgtctcttgaatgaggatttggtggtgtccaggaatgcaacctccagaagtttaacttcttccttcttttcctcaggattaacttcatccaataaaatagaaatagatgtcataactctctctaaagaatcttcatcaatttttttctccaccaaagagctttgacccactcttacaatactaactaaaattagtaaagcttccgcctttagagcattgatgacagttttgttcttggaaacgttttcgaattttaaaacaagtttaatgatggtgttggccagaatggcagctgtgtagaaatcaccacttaaaacaaaccggcgaattggaggtctagaatcacgttcttcatcggtaactgacttttgagaagtcttcacatcgaaagcgctttcagtggcatacgtaccgtctggtagaataactggaccagttggcttggcggtagcgtcaacctcattttcttcggtgtgttcttggttttgtgttaactttttgatttctgattgaaggataggaacttcacctacgctgttacgaatgtgcttccaacaatgttgtatctcactttctccttcagcatactcacccataatccataatgcaccgcggtaagctttagcagatctcactttgtctagcgtttgaaccatgttttcaaggatattggctctaagttgtgggtatttttcgatcacttctttgataaaggcaatgataccactggcggcaaccgagtttaaatcaccgatgaaatctaataatagcgaaacaacacttgctgccatttctacaaagtttacagccacggtacgaatagtttttattaacaattgtctgtactgcattgccttgtcttgatctgggttatttacggttgtttgcagctctttcttcaaaagctgaacaacatcttcagcatttctggatgtggccaagtccattgaaatatcaagcgcctttgaacgaacgtctaaatcttctgcattcaagactctcaaaatatccagggttaactcttccaaagcacctacgttattagcattgatgtcttgaatacggtctagaacaattaacttaatgttattatcagaaaccttgacggccaagtcaatcaatttgttaaccgcaggaaccaagacatttggattggcagacaacacagttagggctaatgcggtctcgaagatgacttcatcggaagtcgtggtcgaaagcagttccatcaataattcgatatattgggctttcaaagcaggggtcctgtttgcatcttgtctgataaattgaacaaagacagcttgtaataaagggtctaggttttctatatcagcaatattgttctctaaatagtgtaaggcattttcacgatctaattcagctaacccaataaatgcatttcttttacatattggatcagtttcagctactatgaacgaattgatgatttctttagcatcgggaagtaaatgttcgctgaccttgaaaatggagaaaactgctaggattgcatacttacgaacatatgcatgacggtattccaagcacgctaagacagagggaaccatctgttctaagagttcggcctctctcaatttcgttaaaaaccttaatgtgttacctctaatatattcattaggatgttgcaaatcgtgttgaatggcattacagacaagaatcatttcatgtctcaattttccatcttcagctagtttgggaacaatttcccagtagaagtacaaaagcttttttaattccttatttttagaaggcatgacaaatcttattatgtgcatcaacaattcaggcattggatttccttccagcattgtaactaaaattgatttcatcgtgtcaattttttgttcatcagatcccttttcaagagctttctgaaaatcggtactcgagtaagtctccatactcggagaaggatcgaaaaccaacgtgtacgctggctgtgaagaaagtgaagtcataggtgcactcttgttcaatagttaactgtgattacttttgtttattctcaaggcaatcttaactgagtcttaatgaacgtcaaatttcacttgtcgagctgttgttttctgatttctttctacgtgtagcgagtacacggaaagaaaaaaaaaacgaagtgataagctgggtaatacttttctaaaatgctgttccataaacgtacatatatgacatctacaaaactacagagaaggatatcattctgggtctgaatcagggtttgccacacgcaagccatgccccagagaatagctgaggtctaccacatcagagttcgttgtggagacagagtcctgacgcgatatattacttctagcattagcatcacgataatcttgaagagagatatgtgtaggaagcttttgtctgttcacgtaatcattatccagtgttccacttctcattctgttctgagaccttgtgtagtagctgactaccgtgttagatcttgacacggaatcaacagaaccgttttgccctcttttttctcgtaaaggcgccattatatcatcactgttatatgcttcatcaccgggtatgtccttgaggtagtcttcggcttgttctgcgtcagtgccttctttttttgaaatagagccagtttcattttccttccctaacaatttatggaattcctttgtgtggtcaacattgattttatttttcagccctgtagcggttccatctgattcttcatttcttgtctccaacgccagtaatttctgtttaactttaccatgcttgataccaatttgcttagaacttgtcctcaacttgaccttaatattcttgggttgaatcaaattatttttttgttttagagcaaccggcaagttaggaggcgcttgtaaaaagttagaagtcttgtaatactttagtcgcagttcttctacgtaactagaaaccaaaggcacggacttttccgatttgttcgatacgacagatgttaacggtgaacatttgacagatctttcgcttggggcatcatgtaccggatttggtaaatccaccgttgcagggatagtaactgtgtgttcattgaacgagtgagcagccggcactaaactttctgaaatggagtttaaactgtttaactcggatgttttatttgatgattttgtgtttccgtttgagtcaagagcagccaaaacagttgatttagagccttttgatatagaaagtcctgactggctagagaagtttgacttggcatcatactcaccagatgatgcagtgtcaaaagaatgcttgtcggttagactgcccgtatcgtttacactatttaaatagaaactagggcgatcttcattaaccaccctaaatattctacgatgacttggtaactcaggctcttgtgttgagacgtcattttttatagatgagccttgatcacttgcgtaatttataaatgctttactttcactatccacaaaacctttttcctgaagaccatcatcatcatcctcgttggaagaaccgctatcaatctcattagttatccgcagaggctttctggcgcttgcaatacttccatcactcccaaggtgctcatttgatttatatgcaaaatcaaaatgtgcagctttaaaaccactagattcgtctttagaaacttgctgaaggcttttggtggatttaccactagccgatgtactaaaggaaaatttatcatccccatcatccagattcgaagaaaattcttttagatgatctgattgtactaaatttccgttacttgctttatttacttcttcattatccacaataagtggttttacgtagcttaaggaactctccgcgctgacatttctcaaaatgggagcttccatgacatctactggcaacttatcttgcgatgctttagtatctgagttttcagacgtgtctagggatagtgagctaccggaacttaccttgtgttcattaatgtaattttcaatatcatctaccaacttttctgcttctgaacgctgccgcctatgttgattgtgggtggatgagattgcaatactatcccgctcagaatcattattactctctatttcttccttagtagtattgttgcttattgacgttgttattgacttcatgtccataggcggtggtggaggcctcgaacgttttatcttggagaaatgtgcatttgaatttgcgcttgttgtgaaggggttggttctctgcccaatgatgttgttttcttgtaaatattcaattcctttgtgatcgtttcctgacgcttccttggactgtgttaattcaagagaatctcctaaggtatcctcagcattcaaaaatggattagtattctttaatgtttccttttgtaatggtgcctggatagaatggctcctgctatgagcattcctatttggacttcttggcggtatatcaggggcagaagtttcagccgtcgaagttcgtgcgatatttgttgatttctttattgtagagggcaccgatggctttctaacggatttttcagagtcattgtttttactttcagaaccaaaccgaaaaaaagaccttcgtttacctttattgttgctaaagccatcaaacatcactgtattattagactttacctgtagactccttcaaaacctgtaattcgctttgcagaacatgctatttcaacattttccctcttaaacttttgccaaataataatagtgcgctctttgaatccgcgatgacatttgaaagaaaacattaaattaaactatcgctttgcatacggagcaaatgccatgaaagagaaaaaataaccaaaaggttttttaaatatatctatacacctccactgttatatgcgactcaatgttctaatatattcaatatcagctctaatgctttgactatatattcaccgactccaccaatactaataacgcggatggtacttgggtgaggcgcctgagcaaaaatagtgtaatttgttgtatttaaagattcaagccacatttgtgactcgtgaagattattcagattcaatacgacgatattacaatttgtctttgatcgtagatcatttagattttgataaacaatatcaatataattttgtcttggacacctaacgtatgtctttagaatctgatacgaagacttctttttcactgcatccatagaagcttttatggtaccaatgcaatgttgtttgatttcatcctgcgtcataaaacccggtttattaccttcactataccttccgtcctcaaaagtttttggcccggaatgacgattggaagaattcaatacatttgatggcttattaacagcgtgtctctgtggttgtgtttgatatgaagttgcacctgcttcaatagtttgagaagaggaaattgaatttgaagagggcgaattcgataaaggtctttgttgtcgtggaaattgatctccttgaaggccacttatttcgttatatgccttcatttcagaaatatgtttaatcatttgagcttttgatgtttctataattggcctggttttactaatgtacgactttatatcaaacaagccatcgccaattaatggaagttcgtagagggcaagtgatatctgtgaataagtgcggttatattcacgcttaaagtagtttatcacgttagcttcacacttgccaaattctacttgtgaaaaaaaattagaaagctcattcatgaacttacttacatgacaagccttaacttgaaactgttgaaaatctggaacaacattgaaaccaacttctacaatactggatgagggctgctctcttctatagcttgttattatatggcctctaccagtttctatattcttgggcaaataaaacgaacctgtcaagttaatattcttaggaactctaaagtatgatttttcggatggtgccatccataatcgcttctggaaagcaagcagaactgataatacgaagcaagagtccaatatattgaagtccttcaaaactatgtagaaaagcatgccttcatctttctgctctttctgtggataacatcgtaatatatccttcgatatatacttatgcaattcatccatgcactcgtcgaactgttgtttatcttccgttctcatggggagtatgagcagactaccttttatgaattgccctgcattcttcttagtcgaccttatcctatctaggtttttccatatatcaaaagattggaatgcttcagaattaccgaccttccttctttggccatcattggatgtcgtaggataatgtccttgtgaaagttgtcccttcggcttggtatgatgatacgctaatcctctccttcttgggcgcatgatactaatattttttgcttatattagtcgaagggaaactgtttctcaacgtcaaacttctactatagtatataatataactttaatgttttctacactgcgatgcgcgctgaaaattctagctcaaataaaaaaaaggttacaacaaaccagtagcaatcatgagaataagaaatatgaagaagtaattaaagatcatgttggagtaaaaatccaaaatatcatctgtttattagcattcgtgttagtagtatattatcaaatgcggtgtaagaagatgacataaagattgaaagacagtcatcaaatggaagaggaaatgcaacaactcatgatgtaataggataatgtcacataaaaaatggaagatgagattataatattattacgtaagaataccgatcctcttttgcgggttcttatatctcggggagagcttctagtacattattcattcataatattatacctttaccaaggattgaatcccaacaatcatcaaattattcacccctttctcaggtcactggtttgaagcaagtaaactacatcttcttataccgtatgcgataatatactaataatataaatactactaaatagatgatgctagaattccattagaactatagtataccatttaagtatttatattgctattgtaatatcttatgaaaagttaatgttcatctgtcccaacaatctctaacaagtacaaagatgacacgagttatgaggcgctgtcataggaacctccaaacaagtttgatattaattataagaaacatatttcaagccctcgtgttgtattacgggctcgagtaataccggagtgttttgacaatcctaatataaacagtcttagggaagtaaccagttgtcaaaacagtttatcagattaattcacggaatgttacttatcttatatattatataaaatatgaatcatactaagtggtggaagcgcggaatctcggatctaaactaattgttcaggcatttatacttttgggtagttcagctagggaaggacgggttttgtctcatgttgttcgttttgttataaggttgtttcatatgtgttttatgaacgtttaggatgacgtattgtcatactgacgtatctcattttgagatacaacacctcgcaagaaatcgactctcggtagccaagttggtttaaggcgcaagactgtaatttatcactacgaaatcttgagatcgggcgttcgactcgcccccgggagatttttttatgtcaagcacctacttttagccggctttctggagataagttcccagtagtcgttgtatttgattctctattggatagtcaatgacacattcgtgaccgaacaatgagatattattgagtaccgggagtattatgtgtcataatttgtagtattatctgtgtgacggattaagtttgctatctcaaatgccgcgcgcgcgaattgctcatgatataataatagctaataatatgataatatgataataatagataagattactgataacattattttagtattcaaaagcgtattacatatatatagtcgagtaaatacttttttttcaatggggagtggaagggacagccgctctgacctgttattaacgacagacaacacggtaccaaagttatacaatgactgtgcactcaacgtggaaggaaaaagttcaattaaaaaaagatcaactgaacagtaagataaaagacgaatggaaattaaacagcacaactataacgaggttgaagaacgataaaaaaaatttaatcaagaatatcgatgatttatgctcatcttcagaaaatcagatcacccactccacgattatggccttgagacaggcactggaagcaaaagagttaagctgccatgaaataacagctgcattttgtcatagggctgctttaattcatcaagtagtgaattgtctatccgaaatcatgttttcagaggcattgagattggctgactattacgacagcaatagaccagccatattgccacccttgtacggtataccgatatctctcaaagaccaatgtaacgttgagggtgtagacacctcactgggttatttatgtcgaactttcaaaccaaaaaccaagaatgaagaatcattgattgtcagttttctgagagatttaggagctattatatttgtaaaaaccaccgtaccttcatcgatgatggctacagatacacaatctaacacctttgggtacacatataatagtattaatttaagcttctccagtggtggatcttctggtggagagggttcgttaattggtgctcatggttccttgctgggactaggaactgatataggcggaagcatcagaattcctagtagttaccaaggattatttggtttgaaaccaacttttggacgcgtcccttacttgagggtggataattcatttgagggaagggaaacaattcccagtgtaattgggccgttggcaagagatctttcggatttgagatacttcatgagttgcgttatcaacatctgtcaaccatgggtacaagacgtcaagtgtattccataccattttgattcctctacaagtaaattacacgataattatgttgttggaatatggtatggtgacggcgttattgatcctccgcccagtgacatcagggctttaaagacgtgcgaagacctagttaataaaactaaaggaatgaaggcagttaaatgggagccttccagtgaactgagcagggaattgtttgatctcgcaaatgaagcagatgttgctgactcaggtaacgagataaaaaacgaattcgaaatttccggagaaccactcctagatattttaaaaccaatggttttggaaaacggaaggcccccatatactgttaatgaatggtgggatttgaccaaaagagtttataatgcacaacaattaatgagagattattacctttctttcccggaatcagaaaggcctgatgttatcatatctcctacaacgctgatgccatttaggcctggtgacatgctaaagacaactttacgatacattttactattcaacgttttaaatttcccatcattatctatacctgtaggtagtgtcgattgccaaattgatgggctaatggataccacttctgcgctcaatccagaagataaaatgatcaaaacatattggaatgatttaatacaatctggtgagatagatgggtttccaataggcctacaagtagttagcccgactttcaatgacaatgaagtttgtaaatttgcgtcttggctttttagcaaaatatagacaataacttgaaagttgagatcttgggtccatcaaaaaaaagaaagaaaataatataactttaatatataatctcattactgagctgtttgccgacgttatatttgttctttacggcttcggaaaagatattgctattcaagggatcatgtttcctgacgtatttgtaaagttcacgtatcaatgattcatcttcagcggcactaacaaaggagacagcagtgccctcatttgctgcacgacctgttctaccaattctatggatgtagtcatccatttttttggaaatctggaaattgactaccaaggaaacattagggatatccaatcctcttgcggcaacgtttgttgcgatcatgatttggactttgttggtgcgaaataattgcaaagaatgttccctttgctcttgcgatttagaaccatgtaaaatcgtcaccttcatgttggtttccttttgaaacttttctgctaaccaatcagcagtttgtttgtaattgataaaaattattattggtggatcatatttagcgacaattggcttcaactttttgaatttgtcttcgtcattatctgcatattccacaacctgttgaatcaaaggttcagaacccgtctcaaccccaatggttgcataaacaggcttttgcatgtatcctgctgcaattttttctataacgggtgtcattgtagcggtaaacatcagggtttgtctattcacagcagagtcagcatttatatcgactttagttaaaatgtttgttacttggtcctcaaaacctaaatcaatcattttgtcagcttcatctagtactaatgtctccacctgtttcatcacaagtaagtgattttctaaagagtcaattaaacgtcctggagtggccaccaggatgtcacaaccctccgatagagaaaatgaaatttcctccaaggagtgtccaccaacaatagaaattactttgcagtcatagttgctctctttggaccatatttttgtaactttttgtgtttctttttgaatttgctgcactaattcccttgttggagctaaaattaacgctttggggccatcaataatcttcaaagatggtggccttggaggtgacctactcatcttgattagtatcggtattacaaaggccaaagtcttacccgaacctgtagaggcaacaccaagaaaatctctatattgtttcatattgcaaacgtttggaatagtaatcctttgaataggagttggtgaaggaaatcgcagctcctgtataataacacgtaacaagtcccttggtattatattgagctcttcccaatttctcaatggattttctactgtcccaccttttgtaacaatagcgtagtcttcttttagtatcctccaatctctctcattcatttcgtgcaaggacttctcagtccaatgcttccccatatatgaagattctgcagcatttttaggagtctttcccttccatagcaaatctatagctctagttgaaacgataggatcatatccgctcagagtatcttcgctttcattccaagaaaagtgaaatttagagccattttgctttgatggatttctcttcttatcatttgtttcattgaaaaaactgtcatctctagagtttacctttttaatctccaccttagcgctatcactttgcgtaggcgtcaaactctcttcgttctccttcaaacgttcttgcttagatctttcttgtttattcaaaaacctaggcttgctgattttacctgatgtattttcatctagtccttttttcttgtttataccagcaatcagctgactaacatcgattggtcttgccatccgtcctgtatgttaattcttcggctcctattgaccttttcgttgtcaaaaattctattgtcgttggtaattctctcgattgtaagcttcgaatatgtaaaaacggatcatcgcgattaactccgaattcctccgacaagtcggtaccctcttccggcggagaatatatatgaacaaaattaagcataagaaaggtttctgattaatattgattcaccaaacagttttagttcctatttttggatatatatacatcaataaacaatatatcataacacatggacgtaggaagttgctcagtgggaaataatccgcttgcgcagttgcacaaacatactcagcagaacaaatcgcttcagtttaatcagaagaataatgggcgtcttaatgagtcacctctacagggtaccaacaagccaggtattagtgaggcttttatatccaatgttaatgctatttcacaagaaaacatggcgaatatgcaaaggttcataaacggagaaccactgatcgatgataaaagaagaatggaaatagggccatcctcaggcaggcttccacctttttcaaacgtacattctctacagacttcagcaaacccaacccaaattaagggagtgaacgatatatctcattggtcacaggaatttcaaggtagtaatagtattcaaaatagaaacgcggatacaggaaattcagaaaaggcatggcagcgtggctcaacaaccgcatcaagccggtttcagtaccctaataccatgatgaataactatgcttatgcttctatgaacagtcttagtggatcaaggctccaatcgcctgctttcatgaatcaacaacagtctggtcgttctaaagaaggagtcaatgagcaagaacaacaaccctggacagatcagtttgaaaagctggaaaaagaagtctcagaaaacttggacataaatgatgaaatagagaaggaggaaaatgtgagtgaagtagaacaaaacaaaccagaaactgttgagaaggaagaaggagtatatggagatcagtatcaatctgatttccaagaagtgtgggatagcatacacaaggacgctgaagaagtcttgccatccgaattagttaatgatgacctcaatctaggagaagactacttgaaatatctcggcggtagagtaaatgggaacatcgagtatgcttttcaatctaacaacgaatattttaataatcctaatgcttataaaattggctgcctactgatggaaaacggagccaaattgagcgaggcagcgctagcatttgaagctgctgttaaagaaaaaccggaccatgtggatgcatggctaagattgggtctagtacaaacccagaatgaaaaagagttgaacggcataagcgccctcgaagaatgtttaaagttagacccaaagaatctggaggcaatgaaaactttagcgataagttatataaacgaaggttatgatatgagcgccttcacaatgctggataaatgggcagaaactaagtacccggaaatttggtcaaggatcaagcaacaagatgacaaatttcaaaaagagaaagggtttacccatattgatatgaacgctcatatcacaaagcaatttttgcaactagcaaacaatttaagcacaatagatcctgaaatacaactatgcttgggtctcttattttacacgaaagatgattttgacaaaaccatagattgctttgaaagtgcgttgagggtgaatcctaatgacgaactcatgtggaatagattaggggcttcattggccaattccaatagatcagaggaagcaatccaagcctatcatagggcactacaactaaaaccttcttttgttagagctcgctataatctggcggtatcatccatgaatataggctgtttcaaagaagcagcaggctacttattaagtgttctaagtatgcatgaagtgaacactaataataaaaaaggagacgttggatctctcttgaatacgtacaatgatactgttatagagactttgaagagagtttttatagcgatgaatagagatgatttacttcaagaagtgaagccaggcatggacctgaaaagatttaaaggagaattttcgttttgatatggttctccgcaattttatgttctcgcatcactgcccaaattcattagcattagcagtacaagctatcctatatataaggcaataaaaaatcttataaatactatcagcaagatttcaaccttggaaaacatgcattcaaaggtcataattgctgctctatttacagtcgtccataatgacatttctctttgattattttcttgttttttcgctcttctcaagtggatgttacataacaaacaaaacagaaaaaattgtttaaatataaagtttaaaagttatctttgattccgcacctgaatttttggattgaaggccaaaggaggtttatcagggagagaaaagctctctatttatttttataaggaataattgtgcatgtacaactatacaatatgtctagtgtaccttataattcccaacttcctatatccaaccatctagagtacgatgaagatgaaaagaagagcagaggctcaaaactaggcctgaaatataaaatgatatactggaggaaaactttatgcagttcgctagcgagatggagaaagctaatactattaatatctttagctttgtttttattcatatggataagcgattccaccataagcagaaatccatctaccacaagttttcaaggccaaaatagtaacgataataagttgagtaatactggttctagcatcaactccaaaagatatgtaccaccatattctaagagatcaagatggtcgttttggaatcaagatcctaggattgtcattatattagcggcaaacgaaggtggtggtgtattgaggtggaaaaatgagcaagaatgggctatcgaaggcatatcaatagaaaataagaaggcctatgcgaagagacatggatatgcgttgactatcaaggatttgacaacgtccaaaagatactctcacgaatacagagagggttggcaaaaagtagatatattgagacagacgttcagggagtttcctaatgcagaatggttctggtggttggacctggatactatgataatggagccttctaaatcattagaagaacatattttcgacagattggaaactctggctgacagagaattgaaaagttttaatcccctaaacctaagagacgacataccctatgtcgattattcagaggaaatggagtttctaataacacaagattgtggaggcttcaatttgggctcatttctgataaaaaatagcgaatggtctaagctgcttctagatatgtggtgggaccccgttctgtatgaacaaaaacatatggtttgggaacatagagaacaagatgcgttagaggcattatatgaaaacgaaccgtggattcgttcgagaataggatttttgcccttaagaacgatcaatgcattcccaccgggagcatgctctgaatacagtggtgactcaagatacttttacagtgagaaagaccatgattttgttgtgaatatggccggatgcaattttggcagagattgctggggcgagatgcagtactacaccactttaatggaaaaactgaataggaaatggtacacgagatttttcttcccataaaatggaagttatcaatattgtaaagagaagcatttacaagcttttatttttctttttaatttccactactggttctgctttaaaatgttgttttataatttatgtacatttaggcctatagaagattctttcaataatatgctacacattcttttatttttccatcatatgttggagtttatgcctcctcggcaggagttgggcggtgcgaagagaagaaaaagagtgaaactaaaaaaaggaatctgcctttgcataagttcaaaagtgcaattttagtgttggatttaaacgggaaaaattgaaatggccatcgaaacaatacttgtaataaacaaatcaggcggactaatctatcagcggaattttaccaacgacgaacagaaattgaacagcaatgaatacttaattcttgctagtacactgcacggtgtattcgccatcgcgagccagctgactccgaaggcattacagctaactcaacaaacgaacatcgaaaataccatcccatatataccttacgtgggcatgtccagcaataggagcgatacaagaaatggaggtggcaataacaacaaacacactaataatgaaaaactgggcagttttaaaggagatgattttttcaaagaaccatttacgaactggaacaagagcggattgagacaactatgcacggatcagttcacgatgttcatatatcagaccctaaccggcctgaagtttgtcgctatcagctccagcgtcatgccccagagacagccaactatagccaccaccgacaagcctgaccgacccaagagtacatccaatttggccatccaaatagccgacaacttcctaaggaaggtttactgtttgtatagtgactacgtcatgaaagacccatcttactcaatggaaatgcctataagatctaacctgttcgacgaaaaagtcaaaaaaatggtagaaaacctacaatagacgcacgcgccatcggaagataaacgcattcacaccaagaaaataaatactacgtacttctagaactaagaagaagttgccgctctccgtctcctccttcataaatagggatagcttttactactacgtacgaaaaaagaccacactgcgacggatcctctgcatcccaacaccagcgatagaaaatgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgactgataccaaagtgtaacccaaaaggggtagtcgatcctacttttaccagttacgttaaagggaccaaaacgtggggaagggatgccgccaccaccaccgccactacccccgccaacatggcctaacttagcagtcctcgcttgtgtatctaggtccgcgtccgctaattcgcgcggcttgccacttaaccccgtccagttaatttgccaagcagcggccgcacgttggaacgttttcgccgatttatttattattatttatacatgttgacgttggtgcccttttgtttatactggagcctaaaacgtacctcaattaaatttagtgtgccatattatagtgctattaaacctttatttttatttttaattttaaaactgctttggttctctccctcccttaccgttgccaccttaagactcactgatatttattcatacttacaagtgctataagaaaagacttgatttattagctttacagcgtttttacatttgtgtcactgctattatatttttgtttacctctttttgttgctggtgttggcgctaccattgtttttttgttttatgagttacgtttacaaaagttcttaacatttactgtacgataatatactaaggtgaaatactaaagtaaaataaaataagagaaagaaaaaaaaaaaaaaaagaaaaaagtaatgatgatgttccataattgcagaattaataactacttaataacttctcaaattggcgaaggcgcgtacggtctggtttaccgtgccttagatattcgtaccgatagacaatacgctatcaaagcggttgttcaaagttacggtgttagcaaggaggctgatatgggcaatgataaaatacacaaaaatagcgtgaaattgcaaaagaagctcgctaaactgttcaaggaatcgaaaaacgttgtcagggtgccctctatagatctagaatcaattgagaatatgtcagaagaagattttaaaaagctgccccattataaagagatttcgctacacctaagagtccaccatcataagaacattgtcaccatacatgaggtgctacaatctgcagtctgcacgttcattgtcatggattattacccaacagacctattcacgtctattgtagataacagacattttgtcactaatggactgctagtaaaaaaggtttttctacagatctgttctgctcttaattattgccatgagcacggcatctaccactgtgacatcaagcctgaaaacttgctactggatacagaagataacgttttcctatgcgattttggtctatccactacttccacatatataaagccaaatgtttgcattggtagctcgtattatatgccccctgaaagaatctcatttgatgggagagtttccagctctaaaagtgggggacataagttgggtaaggtttgtccctcatgtaatggcgatttgtggtcattaggtatcatccttatcaatttgacatgcatcagaaatccctggctgaaggctgacaaaaccgaggataatacctactattatttcactaaggatcccaatatactaaagcaaatcctaccgctttccgatgacttttactcattattatctaagattttacaagtgaatccgaagaatagaatgagcttgcaagagttgatgaaagaagttagttctattacaagcttcaccaatgaaggcccgttatcaaaagtgccgcctctttccaagtctgtttatgaaaagttcgttagccccgtcgataacacgaatgagaatttgtctccaaaatcctacgtgtacatgcacgatagtaaagctgccaagaatttatcttatacatcttcaagtgaggaagaagatggaatcaaagaagggatagacgatgataatggcagtcgcagtggcagtttcggaacgctagacacagacactggattgcattcttcgttcacaagcacttcttgcgagtccgataacgaatgttctaagatttccaacaaattttccttgttcgaaaaaaaattcaacgaacttcgcatgagttcctcttctttaactaactaaccccctcctttttggcacaaaagtgtactacacatctgttttaagcccacaattgatagaccttctcttgatgatcatctgttttcccgaaaatattacttgccaaagcaagttgtagttatattcacacttccgttatgaccccctcatccgtttaatgttatttgtttttatggtattccctttattcattttttttcttgcttttttttgttgatccctgtaaccccttttttttttttggaagttgctattattattcattcacatttgttctgtctttgttaattttccaggtcaccgtatttaatttctatataactgtttctaatatttacttcgttttatccaagcgttatttactcaatattcaaaactttactttttaccacctgtataacatctttttcaatttgataaaacgttttgaaatctaagggaacaatgtcacagtcagtttcgtcgttgatgtctggtaactccagatccctgaattgagactccatcatatcagctttcatgaaatgacccttccttgttttgagccttttcagaacttctattttacttgcatacaaaaagataaaatggaactccgattcagggcatgtgtgcctaatcaaatctctgtatttcttcttcaagctcgagcaagcaacaattgacaaatgctccttagtgcttgctgcagcttttgtagattctacggcaacttttttcaaccagtcccaacggtcgtcgtcatttaatggaatccctcttgtcatcttttctacgttggcaggcgggtgtaaatcatcaccttcgatgaatttcaaatccgggtatatatctttaaattcatggattagttcacctgcaatggttgattttcctgtacctgcagtacctgccaatacaataaccttaaatttccccatagttttgtgtttctctgtcatcaactgcgttgtccatccatacgcttactgagacactatgaaagcctgtttagtcttcggaaagctatttattgcttgctacttgaaaaccttttgattatcgatattttttaacgggaccttatataattattgcttggaaactaacggtgttataatttttgacaaactaattagcgacgtaatgaaagcagaaaaaccgcaagaatatgagaaagggaaaatatcaaagaaaacaaaatatattccttatataacaccatcttttgtacataaatgaattggcaagcacatattgtgcatgcatgcaaggggcagaatcttaatactaagtaatttaattatgcaaacataaccccgtattgaggccttccgccgcatttaacgaccaaatctatgagttttaaatcagacacccgccttaacaggtcccatatagtgctatcagataaaagttcgttttctgtcaatgatggattgtaataatatttcaggataaatttctctatgagctgtaatcttgatctattctgcaaaaaaaactcaaagttcagactccctagtgaatcagcatacgtgaaatataataaaaatattacagtcgtaaggggttcaatagacgctagtttttgcactgtagatccagagacgtataggattaaatctattgattcaaatagagaaacaaaggtaaacttagggcttaggtcagttccttgcatatcaataccttgaaaaaaccattctataaaaggggatatcacatcatatggattcttcaaagtaaaatgattacctagagacttcacacattccctacgtgttaaaaaaatatgcatattgttgtaaaagtttttagggaagtcttctttcgatgtatcttcagtgttcattgaacacaagtctagctctttagatgtatcaaaatcgccattctgcatatcttgatagtgctttctgggaagaaaatgagaaatatttttcaacaggataggatgatgatctagtagtagtctaaaaaaagtttcatgctcaaataatgtagggatcacaatatttcttgaataagcttttatattacttacgccaaactccaggggatcgaaaagatatttttcccacatgatcttcgataataatgaaaaagatggcttcaagcaactatagaagaacctgttcaaggtgaccatcgacggttcaccctttgtgaaaacgaaaatatgttgaataatctctacaggtaaatcttgcaaagttagcttttgatgatgcctaagtttcttcgcaggaagcctgatagtcctttgatcttccgatattggcctcttggatgaaacccgggtctctaagagatgcacatggtgctgcaagtttatcgaagacgatgcataccgatgcaaaggaagtgcatgtttctttctcttatcatgacggctagaatatcctgtcaaaatataacccatggccacttattctaaaaatacactgcgtgaaaaaagcactgcttactttaacaacattagtcctctttaaatatatttcattactcatcgcaaactgaacaattcttgatgcttaattcttactagctgcaaaaaagacaagatgaaacgcggtgtatggttggacgatatagtcttatcctaaatacacacaacatatattgcgtaataaagagatcttcctatctatagcacaatttgaagttgaaaaggcgtatctaaaatgctaatactaaacaaggcatcatgtttttgtcccattcacgtagcactggcgatttgcttccatattcttctgtgtacaataatagcttgggtggcttttttcacaatgggctctacgcgaaattgtcgcagccccctgttggccgtgctgtgggccattctcgagactagaatgaaacagaaatctacaaacatgaaaaggtagagtaaagtcgagtaagtagtagaaaagaaaagtgatattggcatacacgatagcgaagttgttcatatctattatcaccaggccattcattaaaaacttaccgctaaattgaaaaagaggcgactgccaacatacttgcccttttttttttcgctattattagtgtcctttgattacaaactacatccattcgaaaagcttgtaaccaacactaaagtctgtgattctacccaaatatttgctctccgtcatttctattctgtttgaactactgtgcatatatttttctttttgtttcctacattttattcccggcatatctcgcgataggtatattgaataatgacatctgcattaagggttttggtatgcggagatcacccaaatctcattctgtacacatccaggtttcaacatgccaaaaatatagaattttatcttgtgaacaactcaaaaaatgccaactacgaggttagttcactattttatgggacggaacggtttcagattcaaaaccatttccaatcgctcctagatttagtagaccttaataatgaaaatggtggcttggtattcgacttgataataatgagtgcgtcttcactgcaagaaatcccgcaggtattgagagatataaaacctatgatgaataagacaacaaagatactatttgaaagtagcgggtttatatatttggagccattcatcaaggcttcagttgatctttcgctgtcaaatattttcagcattttcaccgattatgacataagacggttggacaatggctcatacaaacagttcacgactgcaaatgccaaatccttttctgtttcgatcggtcaaacgacatccgttcacgaaaacagctattcaagtgatattattcctattttgaatacatttcagaaattgttccaaaaactgtttcctagggacgttgtgactctttacgatcattctccctccgctttcttggcaaaagaatgggaactagctttgcctcaaatatgtttcgatccattattaataatattagaagagaagaatccatcaaccttggatgaccacgttttggccaaacctcttatttcaggtttactaggcgagagcttattaataataaaaaaaatgggtatagccatgaacaatccaaattttcaaaatgaacagactatattgaaacattggaagaataagtgcgaagacttacctgatgggccggcacttttatataatttcatccataaggcttcatctttgaatattgacttattgttattacagccgatattattagcagatgactttggcgtgaagacaccatatttagaatgtttgtttacaatgatgactcaatatcaattgttaaataaaggtgattctgaatggtttattagaaaggatgagaacacagcgttaactcgcgttgatgatttacaaaacagtatcgcacttaaagatggaaaaatcatgcagctgcaaaattcggaatcaaccctgaaaaatgagataaaagaacttcaaagtcaagttttgagcttaaaacaagaagtgtcctcaagtaaagcaaataatggacaagagttggaaattttaaagaagaaagtgcaaatgggagacaattcattatttgatcgcccaaatagtaatactaatggtatatctccctctgataacattgttgatgttgatttaaattacgaaaggagtgaccaaggtaataatagtagtggtaatgatagcagaagacaatcttttttcaactccacatctgatacaacattatccagagatgaaacctcgttgaaagagcgtgagttagaagtacgaatgaaggaattagaacttcaagagcgtgagttagagttacagagaaaagccctccagcaacaacaacaatatcaacagagaccgcctaagcaagtatactccggtccttctggtacaccaaccagcggcaataacaataataaaagttacaatccaaatagaaaatcttcctatagtcagcctcaacatgtggctatgatgaccagcagaggtctacatggtcctagcgctgcaagctctagccctgtcatttctgccaacaattttgttgatccagtttcttctgggacgccatatagcagcaatagttctcgatttagtcagcaaattccatcgcagcaatacatgcatactgttaagccaacgagtagaaaaaacagaagtagtgtcatgcctaatataggttacgtcccagggctaaccaataacgagtatggtagaaagtttaacggtaatggtatgaatggtacccaaagccgtctgaattcactttcaaaccaaagtacgtttagatctcaacagggtccaccgataacacagcaaaaatcgtttcaaaataacggtggtagcatgaggacaaatcgcataccatctgcaaattacaatatttcaaatcagcaatcgggttttgttaactctatttcaagtccaaatctaagcaatttggagaatagaaacacagtacaaaacagtagaaatgcggattctgctccgtgcgttaatcaattgaacagtgactctccgccccaattacagtctctatctcaaaacggtacctcaaaagttcctcagatcaatattacgcaaccatcaccaattcagaccaactttgctacgagtgataaccctgctgctgtaataaaactagggacaccttctgaagatacagtttcagctgcggcaacagccaataatataagtacaatgggagatgaaagccgcaaagaggacgttaaggaaaaaaagaagaaaaagttcagtttctttggaaaaaggaaaaagtaacaaatacgcgagcccttgtctttccaatccaaataatccgtttttgttaatgatatgttatattttatctacttatacattttatctaaaacactttctatttggttaatgaccaacgaggaagtttgtagcttcaacacaactttagatcatgtaataaacggcatatgcttttaaatgctttgttttgtttttttctttttttcccgctgtgacagaaacaattaagttgcgttaaaaaggttccctgatagaaataaatacggctaaattaaataaactactacataatcctacaacatcaaatgcctgtagatcaagaaaaattagctaagctgcacaagttatcagcagcaaacaaagttggtggtaccagaaggaaaataaacaagaaaggtaatttatataataacaatgacaaggataataccaagttacaagctgaacttcataaactgcatccaatgaccattgaaaacgttgccgaagcaaattttttcaaaaagaatggcaaggttttacattttaacagtgcagttgtacagattgcccctcaatgcaatctcacaatgattcatggccaaccgaaagagaatacacttaatgggctgtatccgagcgtagcctctcaattaggtagccaagaacttgagtatttgacaggtttggctcataacctagaaaatgaacagacggtgctcgaccagctgggcgacagatgcagcgagacaaaacaacaagtgatgaatagctgacatagttcataataattgccagtaaacgttatagctagtggcgaatgtcgaagtggaaatgctatcacattaatgttgcagatgaatatatattttcttatttgagaagatacacgctatttactctttcagccattactgctaccattgtggttgttatcttgacgatgaacgatgttggattgcttgacttttttcagtaattcattgataccctcaccacccgcagttagtaatttagtcctgtttctcctacatgtcagtgtatcataatgtcttttcaatgcatctttccttgcaaaacctttgccacattgaggacaaatgttaggcaatatggcgaagtgtgtcttttcgtgccttctcaaatctgatgatcttgaaaattccaacgaacatttcgcacatttaaatcttttttcaccagtactatttctacgatcttggggtttgcttttgctggacttcggtggttttggtaatgcgttttcctttttaacctttatgttaccgccttgactatttatatcaacaccattttctgccggtatgagtgctggttttttattttgtaacctgttttgcctattccttaccctttctaataactcttttattataggatctatgttatctatatttaatgatacatccactattgcttctgtagcctgtttgataaatgcagcatcctgatcctccatttggtacttttttgaaatttataatacctcttgacttttttccactatattattaacaaattcttggcatatgacatgaaaccctattcaattatccagatgcatacatatataccatggatagatatgtatatctactatatctatatatacctcgtcaatgtaatgaggaaagttccgagggcgacaaagagaacaaatatagttttatttataataatgatacagaactcaagattatttcctgcttattttaaactaaaagtatagcaagttctaacccacaatcaggttctttattattgtcaagaaaatataaactgtggcgtactaagcgtactaagtaagggacgaaaaaccatcacaaaatgtcacgtgcatgttagtccagtcgggcaatagatagggactgtaaattaaagtttatattgaaataaacaaaggtaaatggtaaaagattagaagcatagaaagcatctggcgttattttagcggggaaagattttggtggatactatctttgactagtatatttgagtagcaattaatgtctaacgaattacggcttgaagataactatgtaccaacttccgacacactagtagttttcaaacaattgatgaagctgccggtaacggtattatatgatcttacgctatcatggttcgcaaaattcggtgggtcatttgatggtgacatatatttattgacagaaacattagacttactgattgagaaaggcgtgaggcgaaatgttatagtaaataggatattatacgtatactggccggatggcctgaatgttttccaattagcagaaatagattgccatttaatgataagtaaaccagagaaatttaagtggcttccatcaaaagctttacggggagatgggaaaccttacgtagtaaagctccaacctgccaaatttatagaaaatttacaaacagatctagcgaaaatttaccattgtcatgtttacatgtttaaacatccctctttgccagtgttaattaccagaatacagctatttgacagcaataatttatttttgagtacgcctaatatagggagtataaataaagagtctctttacaacaagttagacaaattccaagggaaaccattaatatcaaggagaccatattacgttgcattcccgctaaattctccaataattttccattcagttgacaaggatatttatgctagactagttttgcagagcattagtcgaacgatatcagaaagagaaacaatcatcttcaaaccggtacagaaaatacccgtgaaatcaatacataatataatgactttattaggaccttcgagatttgcggagtctatgggcccatgggaatgttatgctagtgctaactttgaacggtcaccactacacgactacaaaaagcaccaaggccttactggtaaaaaggtaatggttagagaatttgatgattctttcttaaatgacgatgagaatttttacggaaaagaagaacctgaaattagacgactaaggttagagaaaaacatgatcaaattcaaaggttcagcaaacggcgtaatggatcagaaatataatgatttgaaagaatttaacgaacatgtccacaatattaggaatggaaagaaaaatgaagattctggtgagccagtgtacatttctagatacagttccttagttcctattgaaaaagttggattcactttaaaaaacgaaataaacagtagaataattaccataaaattgaaatttaatggtaatgatatttttgggggattacacgaactatgcgataaaaatttaataaatattgataaagttcctgggtggttggctggagaaaatggatcgttctcaggaacgataatgaatggagattttcagcgagagcaggttgctaaaggtggtttactgtagaaaactactgtgttctgttatcgcttccaataaaaaaaaaaaaaaaaaacctatgcaaaaatttcagtcaaagcataacaaaacgaaccttttttgtactgctcattgaagtatttacggggcagtatgggcacttgaaagtaattgttccgttcttcgataatctgtctagcgcctttttagaaatgatgtgatggcatgccagtgaataaggaggattttctgtagtggtttcctcctttaagacgggacagatgaagatcggatggaaatgagtcagaaaatctggtaacttgacatcaaatggcaactcatctttcgtagtccagtcaacgtgcgctaactccctgatggttttgtatttgatgaaaaattggaaagaaattaaaccactcaatactatcaaaaacaagggagagtcaaagaaaatatgttttgcagcacaatattcttttataaataacgacgtgcattcttttaattccttatttactttagaatcaatatcttcaataggttgacctattagcgatttagttaataatggtacgacgttttgcattaattccttctccctatgtctaaagcaatccaggggtgcgttctgtgttatttggtagtacaactctaccggatttccatgcttcactatctgcattgctgacaaagtgtataaatcaaattttagggacgataaagccgtatggttagatgataagctttccatttcattggagcaccatttcagacagctttctgtgtcaccctttttaagatcatgtacgatttggcccatctcaataaattcagtagattctttattagtaattccgtagacatcttttagatactggaaagcctcatttttatttcctaatggcatgttgtctatactatacctcaaaatatggtaaccgatggcttcattaacattttccattgtctctttcggtaatttattgacatatacgctatctatatcaaattcttttaatttgttcagcgtgcttttgttgaagcgattcgactgctgagaaacgtactttatttgtttctttactgaatggtcccattgcctctgtgacttgcttagcttctcaataattagttctctttttctcttaaacttttgtttctccttatcactcagcttattatagacttctggttttgattcctgaatatgcttgtttaagtgcgctttcaacttctttaattgactcttgaattcatgagtatgatcaagacatttttgaaggtttgtctcttccagattgctgtcggtataaaatttcgcaaactctgtctcaaagctatctagtaattcagacatcgtttcttggttccctactcagtgctgcatctctcttgaagacacacttatctcatactgaatgtgttgaactttacccctaataatagagattcctcagctttttccccggcgcgacgagctttcctatgtgtgaaatgataatttttttaactttctaacacgagaatatgagcatcacctattagtcgtataaataaataattcataacaaaatacataaattgtaataaataaaatgtgttaaaaatacacactatcataaataattgtcgtggaaacaacgccactcatttgttacttgagcgtttcaaaatttggagttactcgaaagctcagaagcatgttttgcctcagctacttttttaattgcctcagatagtcccttatcaacacgagcaaacatatcataaacgcgctgctgtatttgaggacaggcgccttctacatgaatgccgatgttatatgccaagttcttttgctgtccaggttgtttacccaaaacgcggtagagatttcttgcttgcacgaaatctacatcacctggggatgttgcccaatgataagggatagctggcccattccatacctcttggtgttgttgaatgggtctgtcctgttggatatacgtgtacgatttatcgttggccaaatatgtaggttctgagccgaagttgccgttaacattcatcggtccatctctgatagcgggattgaaaaatttagatgcatatggacagtttacgggtatttgatggaagttaggacctagcctgtatctatgagcatccgcatatgaaaacaaacgggcctgtaatactggatcagcgcttgcttcttggtaaggaaccgtggtactgggggcgaaggcagcttgttccacctgtgcgaagaagttcagtggattctcgttcaaaacaatcttacccacacgccgtaaagggaattgcccctgaggccatactttagtcaaatcaaagactgaaaatggtaattttttggcatcgcgttcggtcattgtttgaatataaactgtccaggaaggatagtttccattctgaatagcctcaaataaatcctgctggcagtaatctggattggatcccgcaattttggtagcctcttctatggtcaaattctttattccttgatcggttttgatatgaacttgcacataatgccaatctccgtttttattggaccatttataggtatgaccagaataaccatgcatactacggtagttggcaggggtaccacggtctgaaaaaaggatcattacttgatgaatggccacctgattttcaggagtggtgaggaaatcccaaaacatgtcagcatcccttaggttggtttgtgggtttctcttctgtgtgtggataaagtgagggaacttggaagggtctctgataaagaataccggtgtattattgtagacccaatctaaattaccttcttcagtgtagaatttggtggcaaacccccttggatcacgaaccgtgtcggcactacctttatcaccacccacagtcgaaaatcttgttagacatttcgttcttttcccaattttactaaacatagcagacccgcagatatcagtaatgtcatcggttacttcaaaatagccgaaggcaccagaaccatgagcatgtggattcctttgaggaatattttccctgttgaaatgagccaaagaatcaattaagttataatcttgcaaaagcaaagggccatgttccccaatacgttgggtgacaaatggttcattgattggattaccagtggagtttgtcacaactctatcctctcttacatcagagtaatttacttcatttttttcttgtcccaatttcgacatcttctagggttccaaatttatttgtaagtactattatatttatttaacttaccttttaaataaacctacaagaaattcaaatgtacgatttggacattacagtgaagaatgctttctacatctctttatatgtatggcgatatcaaaactggttgtttctccaattctgtcactgtggggattttcggagtttatatttgttaaagccgtcctttttcggattaagggaccccaccaacttgcgcggctaattccggccaactttttgcattactaattgcggctttaaatagtggttagaacaaccgctcacttcttcacgcaaggacgtttgacagagcttttttcttcctctgtcaactttctctttaaaatattagttagcagcttttcatcaggaataaccttgtaattcttgtcgatggtttcttcacaaacttgcagcgaatctatttcgcttttcaaaactctccgagccataacatctcttagttcttcccttgttaatgagtttcctttcgaaggtttttcgatagaaacgcacttttttatggggtaatcggctagacgcttcataatacaacgtttccatgtggcactacagtttgtagtggcgcgggcaccttctatcaattgtaaacacttctttacaattctctccacttgcctttccattgcttttatgtccagtttgcataaacctggaatttggcaaagaattgtcaagatttggaccaaaagtattagttgaggcaacaattcaccattattataacaatcatatgaatctagtactatttcttcaccttctaagaattcttgaatattggcgttattgcgtaagatatcaatacacctgtccaaaaattcagtattcgtctcaaaagtctcttttaacgcctcgacaatattttcaagtaacacttctccaaaatcatacttcgaaccgtcccattcaacatacccatatcttcttagtagttccgaatttggatgttctccgtatatgttgtacacttgttcattcttttcaatatccctcaaagcaaccatctttaaacagttagagtcgtaagttaaattagcgttgcatttactggtatctgcattcaacatatcagcaagtggaatcatcgatttcaagtagcgctcattttcaagttcttcttcactggtttcttcttcttcattttcatttacactactatcttgcatttccaaatcaaaggagtaactcaatataatgcttgcaatataggcaaaattatcaaactcgaaggacgtcgctacacgtgaaaattctccaccaatttgtttgattgatttaataattctttcatgcatctctttggcttccttttttcctattctttcaaggacaagtgatggttttaaaagttgcagttcattatcatcccaaaaaattaacgcgttcatatcgcttggtttgttccaaactttaaagtaaggcgcccatcggcttctttcttgcaaaacttccatctcataaagtatacagataattaaaccttcccacgatccggtttcgttcaggaacttatccttgagagaaggataatcctttatcagttgagatgttgtaacgcttaaaacagaactacgaggtattttaaacaatgtttcatccttcttaatcttttgagtggcaactactgcgcggccttgattatcacaacaaagatctttgatttctatcttaggggatacttcaatttcagcggtagtttttaaccagcaaacaaagttttcggtatctcttgaaaaatcatccattttcgcaaactttcccctttattactagtcatattgaaatgatcgtattaagcttttacaaaggtaatgaaattttttcatactcgagagaaaaatatgtgacacatgtgtgtattacccgcagtaactctcgaagattacatttgaataatatcaatacttccagaccaatagctttattgtattgccagggcacttggtacatgtaacattcatccagtttatttgataccaaaaatcttttattttaattcttctatttacaaaagagaaatgtgtatgtttatatatgtattttcttgggaatttattattcataaaccgcttgtgcagttacttttcagcttcctcttcaacaacttcgccttcttcatgatttggtagcacgacaagcttagtatctttaaccaccactctaacagtttcgccgtttctaatttgaccttttaataagaaagttgccatggagttcaaaatctgtctatgaattaatctattcaatggccttgcaccatataattgatcgtagcctttgtcagttagccaatccttcgcttcatcagttaaatcaattttcattcttttttcggccaaacgatcttgaatttctgcaattctaatatcaacaattgacctcaaaactttcttggatagcctattgaaaactagaatatcatcaatacgattgatgaactcaggtggataggatcttttcattgcttcgataactttattcttggttgcggtgtcaatcttaccatcatcacccaactttgtgtcgtttaataaaatatcttgtccaatgtttgaggtcatcacaatgatcgtgttacggaaatcaacatgatggcctagggaatcggtcagcttaccttcatccaacacttgcaacagtagtttggaaacatcggggtgcgctttttcaaattcatcaaataaaacgacagcataaggctttcttctgacagcctcagttaattggccaccagattcgcttaagacgtaacctggaggtgcaccgattaaacgagagacagtatgcttctcttgaaattctgacatgtcaaaacgaatcacatttgattcgtcatcaaataggaattcagctaaagccttggtcaattctgttttaccagtaccagtaggacctaagaacataaagctggcaataggtctcttttcactggtcaaaccagccctttgaagacgtacagcatcagaaatagcagcaatggcctcgtcttggccaacgactctttcttttaaagaattttccatatacagtaggcggtccttgtcgcctttcatcaccgtttctgtaggaataccagtcattttggcaacaaccttagaaatatcgtcagaagtaactgaatcatgaagtaaatttactttatctccgtccttactcttctcgcttaaagctaccttcttctccaagtcaggaattctggaatatcgcaactcggatgctttagtgtaatcaccctctctctgacacttttccaactcaattcttgcttgttccaaatttgccttagcatttttgatagattcaatttcagctctttcagcgtcccatatttttgttaatctgtttaattcatcatttttcatttctaggtccttttccaacgcttctcttctttccacggaaacagggtcggtctctttctttaaagattccagttctatttgtattttcataatagcacgatccagtttctgtatttcatccggtttggattcatgttgtaaacgtagtacagcacaagcttcgtcaactagatcaatggctttatcaggtagaaacctgtctgttatataacgatttgaaagaactgcagcagacactaaagctgtatcagtgatccttacaccatgatgaacctcgtacctttcttttaaacctcttagtatagaaatcgtatcggagacgctcggctcattcaataagataggctgaaaccttctcgataaagccggatctttttcaatgattttgaattcatcaagagtggttgcagagatacaacgtagcccacgggccagttttggctttaagatgttagaagcatccatactaccatcagttttacctaagccaagcagcatatgaacttcatcaatgaaaacaataaccttaccattggccttgtcaatttcttctaaaaccttttttaaacgttcttcgaattcacctctatatttggcgccagcaatcaaagatcccaaatccaaagctactagatctttatctttcaacgagtcagggacctccccagcaacaattctttgagctaacccatcaataagggcggttttaccgacaccagctcgaccgatcaaacatggattattttttgttcttcttgataaaatttgaatagctcttgcgatttcttcgtctctgccaatgacagggtctaatttaccgtcgcgcgctaattttgtcaagtttgtaccaaattgttctaaagctggcttttccggttgctgattgggatccatcctcatttggacgtacgttcttttgaaattgggcaatccatatgagctcttgagggcgcaggttgaaatagcgacttcatttaatgcatttgtttttatatctgatagaagtttattggctactcgaggtcttgcattaaaactgcaaatagatcttttacactgtacaatagtgtatattcgtggagtacttcgccttaatagttgcgttctctgtaaatatttttgtattggtgcttttgtagcttgtcttaacatatttaaccttgaaagattttcactcgcttgtttcagggttcctggaatagataatagaagtcaaacttttcatgcttacatatgcatatatatgtatatatatgtgtgtgcgtgagtcagtaactagggggtttgatgagcttagatacaatgaatcacaggggtttattcaaaaaaaaaagtccgtgcaccccctattcaaacgcgatgccattagatgaaagaacacttctagaacattctggaaaataacaaattttatcagaacagaatcacaccttgatttgtctgttacattaattattaaaatttatatgacctataaggccaaagcaaaaagttgatcttccagtactagagatcaatatctgctccctatttattgtattacgtggcactatccgagtgtctccctactatttcctccagggatcttatttttttttttagttgctctatttcatctcgttgttcttgttcctttcttttagtattttcaatatcctcgatcattcgtatatattcagcgtggaagcgtttattctcaagttttaggttttcattttcatttcttgacatgttgtgttcattttttattatactattctcattcttcaacatgttgttttcgttacataagacatcatactcacttcttaacatagtaattgcattccttatagcttcatgctgagctattaaaatgttgttgtcatttcttaatgaatcgtttaatgatttgaagttattattttctgctagtaaatcgtcaaatatctttgatttttgttcgagattcttgatgtatttttctttcctttgtctaaatgccttttgagcggttctattttgagcagctcttctagtatttcttaaagttttgcctgaactacttatgagttgggtgtctttatcaggaacaggtttggttacattatcattattatcattattatcagctgaatttttagcggtatcagcactgttttgaaaagaaggaggtgcagtagtaacactggtattgcgagatgggagggttgatagttgctcctctgcaatatactccttattcaaagatatgctctggttcggaagtccatttggtaaagggggatttatttgataaggtgcataagatatggaataacttttaggggggaataccacggaaggttgaatactaacatgagcattttgaggtctgttgtaagaagctgattgttttctttcatttgaatgcggagggatgatataagatggatgtataggactttgatgcatcgatctatagtcagacggaccagatagatgcatcaagtttggcaaaggaggctggataggattgctgttaacagatatgtcggtgtccccattagtggttgtaggatttattctataaggtaacttttgggacgtgctgggctgtgcaatttgcggagaaggatgctcatttagattcttctcagaggcattataagtagccattgagctgcttccctgattatacatatcgggacgaatcaacggagggttttgcatttgtcccttagcactcttcgttattctgttgtttattgaaatttctagacaaaagtatatgctatcggattcacgattggtggggaaaaaaactcggtgttacagtttgaggaaagattgtgtttaatattggttctgtagtacactccacaatctctcaactcgcattgctttccaaagatagtctactctcgatactacaaggctccactaactgtgttaacaaaataaacaaaaaaagagattctccagaaattaaaaacttgagaataaaaaaagaaatcaaaaggaaaagaagcagggccaagaaatacttaattagcgtttcaaatgcagaaaaaagtatgacagaatggaatcaaagagtatcagaaatcattaaaaagtaatagtttacatttgcctgcaaacgattcgaaaaacttttatccacatgcagtaaaaataagtgcaagactatgtttaaaattacaaagaaagcataatcttgaacaaagtttctacccttcggcataatgcaaaggggcattagctaaaaaaacaaaaacgggtacgctctttcttaaattcgctattacaattccgcagatgcagcaagcagcgaataactttaacttaaatgaagtacggaaaaaaaatttaacatgctataaatcagcccatataaacaccgcctatcccccgccgaaaaactagccggatctatctaaagcgccaaaaatcatttcgccggaaacaaaccgagaaaaaaatgcctttctcgaaagtaaacaaagcagtacaactgttttgggtgttattttgttccgtggattttacgccactgttttgctttaaaaaaatttctcacacaatagtctagtctcaacggctgtgcatagtacccatacaccacaatttctgactaatgatcagcatatacgtcacgttctgctcatcgtgactgtgggagagccagttcgtgccaaccgttatttcttgcgtacgccaattgtgtgatgcgcctatcaaaaatagaaccagttatcgtttcttttcttggctcattggcaccgtcgttcctggaattggttcccccgtttaaagaatgatcgaacgcctgtccagcaaacgtcactactccattactctccagttccatgccattgaatagattccaatcgtcttcatcatgaaaagagttccagtagcggttgctattttgttcacttgtcattaatgccttaccttgagcgctctcgcgtacattagaattcctttccccatcttggggagctcttccctcctccgcgtcggtgcgagtattatctttcatagccattgtaatatttgccacttcgtccggaagcgccagtatatcttgattccattccgcatataatatgtgatgtggtgctggtaaatggcggtattgaaaatatgaatccctataagaacttgaactcataatcgtggttgttatactttgctcaccccacttctctgatattattctcccttctctcacgatacagctaggccacggcacaaatatgatgtagtactaagatttttttttttgaggttgcaattcagattgttgtctttttctacgacatgcatagaagtatatcatatgatatttcgaactttgggtgcttttctacatagtgcctacgttctgagtatctataataatataatgaaaagtgtatatataattagcaccattaaacgcaccacactgttgccgtttactttaaagagaagcgcaaagagcggcaatggtgatagcgagtgcgcatacgctcgctttccaggtcaaactcatatttttgattggtaatagctgcgaagttgttagtttattagaaattgcagcattcttactcttcctggaagtcgtagtggaggacaaaaccgatgacgttgttcttggaaatgcctgtgctgataaagaggatgagaatttttcttcgatagatccatctgctttgaagtacgtgtagttgtcgaaaggggaagggaaaaggttagcttcttttagcttcaaataatcccattctacggcgtcttcggtcttccaattccaaaaaatccatcccgttgtttttgacgaataagtggctagctgtgcctcaatgaattgtctcacacggtcacggtaatcttgcgtccaatcagctaagctattttgggatatacatgttccaactggcttgtcgttggtggtaaacaacgttgtattgtagtatgatccatcgtaacgtgcacccaccccaacaccatttagccaggttgcacaatcagtaatagcgcctgaccattctccgactactgctgggtgaaaagaaagttctttgtggatagagtccccataattgataatgttttcaatacgtgcaaactgagtttcggccaattgcgcatcagtaaacacttcataatgatgatggtcgaccaatatatcttgagagctgtaatttgcaccagtcaaattgaaataatgatgcgatacattctggtaggttgggtttagctccaagttccagtgaccgattccttgaaaaccgtcatgaataacaaacgtagtgttgtcactcgaattctgatttttcttgagcaagtcaaatgcttcgtaatacatctccgttatgtctgaaacatcgattttgccaccaagcggttcgttgacgatttgaatacccaccacaggacttttgtcacctttatttaaaaatgtctggaacatatctctccaaatagccagagtcagttctttagtattattcaaccttaaccagcctaaatcgccatagagtattctttcaccggaattatcgaatccattctgggatccaggagcaccatgtagatctaaccatacatttagttcgtacttttgcgcccattcgagagcattatttaaatatttcagttgtaatccatcacttacgtatggatcattgaaagttatgttatcgatgtacaagtttttatcagtattttgtttccacgcccaatatccgatggggatcctaactaaattgaaaccgttggttttgatttgttcaaaatcatcctctgtaatccaagttttgaagtgattatccaataaagttagagaggtgttatatcctaaggttttacaaagagtaaattcgtcgacaatggagatattgctggaagagttttgctgttttgccagtgacgtagcattacgatataatgatggcgtgatataaggttctgttactagccagccgccaatagtaatacctttcacggtgatagtgtcgtttgcatagtaggaggcgaatttgttttgtaaaatatttagttccaaaggcgataacgattcttccttctctgtggtgccaacgccttgcgtgaatttagacaggcataaaactagaaatgctgaaaaaaaaaacgacttcaaaggcatattaggacgtcccaagtaacgaacggtctacaattgactattctatagaacgcgctaaaatctcagccaaggaaaagagttttcaaatttatataggcgacgacgtattctcgagaatttgcgtttttcattgtattgtttattttcttcttttttcgcgggacttatttcttgaactctgtccgtaaatagaattaaagggacacatttttgcagcgtccctgaccttgtgatgtttcaaaataaacgcacacattatttttaaatggcaatttcacgtagttttagtggtttgaaaataatgataaaatttgggcattaattgtgcagattatcagtcaaaaagtgaatcgaaatgtatcccaatacaatttcatgtgcatatttcactactacgaagtgaatattgtaaaaatcacgttatgacataactgcttttagtaaatctataaattaaatgattaatagacatgtacccgaggataataggattggcgaaactggatatttgtttgtagtatcacaggttaacattatcgttttaggacctttttcactttgtctggtgatcttggggaatctctatatcttgagatacttgatttaattaggcctccataaccagattatgcatattcgattggcaatgaataacttataactgaacgagttgtatcattatcgatatcgttatatatggtatatccaggactgacagtcaacatatcacttgacactaccttaaaatattcaggatttactaggtataatagacaacagactagttaacgacaaatactgaacatagagacgtacaaaatatgatacttgtgttcctgccacagcaaagttgatgtacttagttgactgtatataatttttttctttcaacctctgctttatctaacattatttggcatttttttatttctatctagttagattttaactataatctgcttattcagtatacagtgtattctctattttatttttttgttatttttacatgttttcaatttagtctactaagattatatgttacaattcaggtactccgtcaaatagcccccttaaaatactgcttatgtgcacctggcatgaagattggtatgatatgcatatgatatgttctatttctaggtttattgactctatgttttctttctaaaaaatcttgaacatggtcgcgacagctactttgacaatcattgataatcagccgtgcgtcagaactgaaggtctgctaaatgagcagaagaagccagagcgtaaagttttctgtacgaataaagaggggggaaagccgtattttttattgaacgactgcagaacggaggattatgactgttgttatgaaaatagctaatatacaatatatgtgaaactccttcgcaagtataataactcacatagtctttgctcttcgccatcagttacaaagtgcgctgcaacttccgaaatgcgataagtcgtgatgcggttacctcgatatcgaaaccttctgtttgtccgtaaaatatcgtgtaacactaaagcatactttttctcatcgatttatggctcatcgaccaaccgaattctttgatagttaatgtatgctgcaggcagaagggcagccgtaggtataaaaaagactagagttcacgatccaagcactatttgccatttttgtgccctttcaaattattcttttttatcgcattgtcattctggtactattaaagtaaaattaaaaagattgaggaaaatttttggtaaaaacgacaactgcaggactcgaacctgcgcgggcaaagcccaaaagatttctaatctttcgccttaaccactcggccaagttgcctcaatttacaagtaatttgaatattattagatagtatgatgcagtattatgacacacatctaaacgttaataaaacacacatgcaacttgttggaataaaaatccactatcgtcttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtatagaattgcagattcccttttatggattcctaaatcctcgaggagaacttctagtatatctacatacctaatattatagccttaatcacaatggaatcccaacaattacatcaaaatccacattctctacatggtagcgccgctgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccatctatgatgacgtgttcacattatcaaacgtcacctgcgtattatcaaccggacccacactatccgctgccacagtatatcccaccgctgagtacttcctcacctgatccaatcgattcacagaatcaacactctgaagtacctcaagctaagacaaaggtgagaaataacgtcttaccaccacacactttaacatcagaagaaaacttttctacatgggttaaattttacatcagatttttgaagaactctaatctcggtgacataattccaaatgaccagggtgaaatcaaaagacaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacagtcagtacgatcattcagaggctaaaagaaaacaatatcaatgttagcgacagattggcctgtcaactaatacttaaaggtctatccggtgatttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacgaaggttacaagtcgtaattatcatagaacaaatagttcaaaaccaagagcagcaaaagctcacaatattgctacatccagtaaattctcaagggtgaacaatgatcacattaatgaatcaaccgtttcatcacaatacttaagcgatgacaacgaacttagtcttaggccagcaacagaaagaatctaagccaacacgcacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaaccaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaagaatcggatattgaatggtctaacgctagcacatatcaatgtcctgactgtctaatcggcaaaagcacgaaacataggcatatcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtctacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaaccaatccaaattggaccaattcaattatgatacactcacctttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgatttctcgtcccaatcattgaaccctttacaattagacaaggaaccagtccaaaaggtacgtgcaccaaaagaagttgatgccgacatatctgaatacaatattcttccatctactatacgatctcgtacaccccatatcattaataaagagagtaccgaaatgggtggtaccattgaatcagatactacttcacctagacactcgtctaccttcactgcacgaaaccaaaagcgacctggtagtcccaacgatatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaactaataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcattgtcaatcgcattagacaatgactattatatcacacagctggacatatcctctgcttacttatatgctgatatcaaagaagaattatacataagacctccaccacatttaggtttgaatgataagttactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaggtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtgcatgaaatgcaaaagttgattggtctagcttcatatgttggatataaatttagatttgacttactatactacatcaacacacttgctcaacatatactattcccctctaggcaagttttagacatgacatatgaattgatacagttcatatggaatacgagagataagcaattaatatggcacaaaagcaaacctgttaagccaacaaataaattagttgttataagcgatgcatcgtatggtaaccaaccgtattataaatcacaaattggcaacatatatttacttaatggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagatgaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtatagaattgcagattcccttttatggattcctaaatcctcgaggagaacttctagtatatctacatacctaatattatagccttaatcacaatggaatcccaacaattacatcaaaatccacattctctacacgtctatcaactaatagttatgagatatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgtttgttaatagtttaaatgtttttatcggaagaggttttgtgtttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcatattgaatttcctcatcactttcgcctagatttataatcttggtgtcgtattgcatcttaagcttctctataattcttttgtttgaatttagatttttgctaaacaataccatatcatctacgaataaacaaattgtcacttgactgtttttaaatacgcatgaccatccacgaacttcttccataccacattgttgtatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcttgttgaagataaacattgagtttattactcttttagggtctatttcttttctgtcataatattcgtcagtgtcccaagttttcatcttcaacagttgattgacttctttgtggtatgcctcgatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactatttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttactgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttctcacattcttctgttttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcaaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacaagttatattatcaatatattatcatatacggtgttaagatgatgacataagttatgagaagctatcatcgaagttagaggaagctgaagtgcaagaattgtttcatatgtgatttatgaacatttagcatgatttattgtcatattgaggtatggtatgtcgatgataaaacaaatccaacaattgtgagcgcaagtggtttagtggtaaaatccaacgttgccatcgttgggcccccggttcgattccgggcttgcgcacttttttagcaactattagcgatcaatatgaagggtttagagactaggtgcctgcctcgcctactcagcattcgttcagtcaatattttatatcaccgttaataatgattaagcagttttttttgttaataaatccggtcatcgggctaactaatcttcaagaacaactagacggtcatccccttttgcttcataacttctccttataatataaaaacttacaaaacgaccatgatattcaatctacctgttagtgtgctgctttatttttctttgatatgggcaatggagcctagtttcgtaagaggtaagaacgtcgtcaacttaattactttcaaagattcaaatggcaagctgcacaagcggttagcaccagaggaaataccgccccggctacataattctcaagtaaattcttatccattaggatataagggaatgcgtgacttttcaagacccgcagtgaatttagatgatattttagggacacagcaaagaaagcagcaagagtttttggctgaattgtctcctttatccttagaatcaaagttgtcattagtgaacgaggtccaaatatttgcaagctatgtgcgaaatgatgttgaaacatataacaaagtaagtgaccccaacgaagatttgattattattgcaccaacgaacagggctgtctctcagcttactttaaaaccgtggcaatttccgaataatattgataagcttgaaagtgatggtgccaccgagaaggaacttgatacggcaatacaagagaatatctccaaatttgtgagatctcatattgtagtgtacaatgatgataaaaattcctacaagaaggtgagtccaggatgtacgctcctgcagagtattgacttcacagaaagcaagaaaagcgattcggaaactggtggtgatattttactcaaaaaagaaggagaagtatattatgtagcttcctccagagacgagaaatttcatgccgtcgagagcattgaaaatggaagcaatggtgttattttgatggttgatttcaccctggtgggtccttagttatgtgttgcttatggttttgacttccttgaccccatacaaattgcgttctttattttttttggttataatttattaataatggcgagtaggatcggcctatctttatggagtttacaacataatatatacattggtatcaatttgttttatagttatattttctctagtatgtgaacgataattttgttttacgaatccttatattaatgcttagctggggccggtggaataagaatacaactatgaaaatattacaacaataccttcgaacatatatatacaccacttagaaaattgatggtacggtgcctgagatcgctgctggtgaggtcatataaatagaggatgcgtttttgttatcaagagaattctccctctccgataacacgtcctgcgtatccactagcggttgctccactttcttattgaatgagttggattcacccccaagtagacctactttaaacagctttcttgcttttaattttctttctctattaataagtttagaagccatatctacagggtgcaactccccttttgctatcatttcatgaactttgtgatcaatatttttagtattaatgacatcttttcgtacccctgatcccctttcaacaacggaaccaatacatttcataattttaataatttcagcgtgggaatttgtgactgctttaggaatattatttaaagttgtaatctgatttgatagaggacaaaacactctttggtattgaaacgcataattggcgaactcaacctgctgcttgaacgccttactgaaacaaagtttttctgtccgttctatttgtataaggatgtctttcatttcagaataccgtttcacaatcttcatagcagtgactacacccactttccaaattccgctagtgtaatcacaccctgctaaacaaactagattacgaaattgttgttcacttaattctcctagagggaaattttcaggtaaagctgaaaaatcgtcttttgagatttctaaagcttttccctgatcatttaactttgttatgagtgttttacaaccaaagaccaacaaatcagaatcttctgatatgataccctgtataaggcccattttttccaagtaaaccatttgcggatctgcttcaaatggtgcaacaatgtagggaattgaatgtagtttgcaataatcaataatacatttcgccatttctggtgtgatgtcaacacttttttgaaaatattccattgcattatatctgttgccggctgaccacaatttctttgcaatcatttcgttttctaaccttttctttcttcttctagtttctgtatgatttttcacaaaaagggaatcaccatcaaaaactatatatggcttgatcttaaggcgttttaggagttgcagccttttaatgaaaaattgcaagtatttgtttgttggcttattcatcacaagttcaaaagcacacgcacaagaagccctgtgtagccacgcataaccatcaatggctaatgtttgatacatgtattttttcagggacacctgtttttgaattctctttaattgaggcagtaagccaggtattcccattcctatcgaataataatgttcttgttgttaattttgatgatcgttttctcttactcgctaaacaatatctctttccatattaagcccataaatatgattacttttctcgaattaccacgaacgacatagagtgccacatatcccttttgtgcaactattatcctttaacgtgtcacggaacgcgtcaaaatggtaatatgtaaacaaaggaaagtgaaatcaaaacaaaactagggcagcttccagtaatttcccaaaacaaacatatgtatattatatatatatgtgctttgaaatgaatgttacaaatgtggctatcttcattttttcagctaaacatttattaaccacctcatgagctttcctaatagtccttgattcagccaatcacttataagaagcactgcagcttgaggcataaacttttctatactcacagttgtttgataaaaggctaaaatatacagtttctcctaatgaaaacaacaaaattttcataccatatcatttccttgttcaacatccttatttggcaatttgtaaagcttaaaatagtcaacttctatcccgttgagcaaagctttagagcccgaaggaggatacaaaattcgcctccacaaaggcgcatttatatcgcttgtaagccaaaagtctttaacatttcttttccaaccgtaatttgttggtattcttgatgtaatcgaatacacattatgtccggtgctatccttgatgccaatggtttcttttataaccgctaaccactgatccataccagtcaccgcgtaacaaacgccaaaacaagtgcgtggtttccttatcgttgagcctgggactggtgctagtacagtatcattactctcctcacccggatcaatcgacggcgcaaatccttctggagtagtattgaagttttcattgaaagataacccatcggggccaatggacttactctctttcatcaaaacattgaattctgtattggtcattcctttacatatttgaaaggcttggacgaagatcaaacttgcaacccaaatagattggagtaaagcccataataatatcagaaagacaaatctatcatatattaatcccgaacagagatctgaagcgcctaggatgaaacatttgccatttttctgggatgtatcttcgtgtgcatcttcaagttcatcaaaatattccaggcaaagtgcaagaaatgtgaaaataccactttccattaatgtaataaaaaatataaatgctttgtgatttttgagtccgacatcattaaagatccaagggcagtaatgatcaaatcttgcaaccacagcattgtttaagggcgaaaatttgcttcttagaggttttctaatccaagtttcgatacaaaagttcttcgtatcaaatttaccgatttcgagcaagttcgagattgtttgtcgcacgttctcatgatcagtttcttctggcaaacatcctgggtccataataacaagctgcccaaaaaggtaaaatacagaaacaagtattaccagcattaggatgttagtatattgttcatcagaaaatgttcgaggcataactttgaaaaaccaaacgatagtcacccaaagtaaagtgccaaaaaaaacaccggataacaaaggtgaccttaacaaggtaacgttgtggacacccattcgtccatatgacggcagaacgaatttgttcaagcctttgttagtggcaatggccaataaaaaaaggacaatgattacaaacaaagggttaatatgagagaaaagagcaaatgcgattcctagaaatagaaatggcgttatgaatgtaacgagcttagcatgttgactttttttgaaccattttttaatgggataaccatggtagtcgaatccagaatgtgttagagcctctctaagtgagtacacagtgttcatttcttgagcaatagcaaagcaatcttttccggtatccgttttttggaaaaaatctgcaccatcttgaatcaagtattttagtacatgtggttgcccttttacagtgccccagtgcagtggggtgaatccttctgtatctgcgatctttatgctggcaccaaatttcaacaattctgctacagttagggaatctccctggtaagcagcccatagtagtgaagttctgccctttgggtctcggcaatctatatctaaaagacctttgctgacaacgttgaataaaacgtatagaactagcattatatttgagctgttcacagataagtgtagtagattgaaaccttggtcatcggtcatggtgggatcagctccatgcttaagcaaaaaatcgacaatgtacacgtacccataccttgcagcccaatgtaatggtgtggcatgcaaagcaccagcccttgcattgacatcagcgccttgtgaaactagaaaatccactacagaaagtctgttattaatacttgcccaatgcaaaccagtgatatgttccgtagagtcaccgtcgttattaacttcgagcaactttccatgtatcatttctttgacagtcgctagatcacctctttggcaagcggtatggtagcgagttaacagaggatcttcttcggcctcatcattatgattcacctgctcgttcccgctttcctcttcatttcctgatcggatagcctttaatgatgccaacgaagtaatttcgttagaatcacccagactaatatcttcctgtgagtcgttattgctaggatcaaccgtttgctcttcattcgtcaaggtcgacgcccgtggcacattctctaattcgttcaccatcaattagctactctgaacaaagaagtgtttttttatctagacgaaacggaaatgatatattctacttcgtggtttgtaatctactaatcgaccgtatatattcctcgcttgcacttgtgtctgtacattacttcgttttatagatcgttcaatatgagggtgtaataagaaagtacgaaacaatgggctggctttatcacccggagtgtagggtacggatgtttgtgatcagagtaacccaatgctaaaagtcgttcggaggaataagcagcaaaacgtgaattgataatattataggagccaaagttctaacaatgataacgtctcaacagctacatgagctgtccatatgtgcatcttcttgcaagtaatcagccggttttatcacaatttttacccaccgtgataatctgagagggcgaagtaggtattagccgtttacattagaaaaataaggtagtggtaataaagcacactacacatcgaagaaagaaacagacactactacatcggtggggggtcatacaatagaggaccaaaatgaagaatgataataagttgcaaaaggaagcacttatgcgactatcgcagctaagatttccatttgccgatgctccaagtatagtacaagcgcatcaaaaagatgaacaaatccagggccttttgattatgaaagtgactgaattgtgcaaattgataaagagtcaattgtttgttaactcttaccctaaggaactgtccatatttgccaagctcctgtatttgctctttactacaggaagacgtggtagaacgttaggtgaggaatatgttgacttgacatacactaataggaagggtaccagacttgcaggacggctcaaaatgattgtattcgctttcgcttatcctttatgtccatatttcatcaccaaactatacaagaaaataatgaagaacaacaaggaaagtaaaattgaagatactgaaagtgttgccgcgttttgtaagggccttttagatttcattttagacgtacacatgaccctcttttatttcaaaggagctttttacagtatttccaaaaggatttttggtatgagatatgtttttaaacatatattgtcaaaaaatgaggccaattttagagaagagggctcacaaaagtacaaagtattaggttatatcctattagctcaaaatgttatgaaatggtaccctgtcctaacctctacgctcgggtcctggatttatgggagaaaaaggaccaatgattcaattactaggtcgtctgttggtctacaggagcgttcagaacatgaatctatagaaggcataccgaaggaatcgcagctgactcatataaatttgtcagataaaaaccaattgccatttattccagaagcctcgagaaaatgcatcctatgtctcatgaacatgagtgatcctagctgcgcgccatgtggacatctattttgttggagttgtcttatgagctggtgtaaagagaggccagaatgccccttgtgcagacaacactgtcaaccacaggaaattctggtcctgcggcaatagaggaactaatcaataatttgactactcttttagcattgtccacaggcctttttcagaaataacgcagacgtctgagcaggagaagtaaaacgcgaaggggaaataatgctttttagtcttgtaattatattaattaattaaataagtttttctttatcggaattttatttaagactttcatttctctaatgctattgtcagttacaggttagaaatatatttccaactatacaccaatgtggaataacagctgcttttgtttgcctttctttttatttcctccactagttgtgttcaattccctcaaattatcgtgcacgttagtatcttgtgtgcttgactttttaccccactgcttaggatcagcaatttggggtctgttcagacctggaatttgcacctttggctttggtggaggtagttgaggtaggttgagacttttcaatttatctttgctattatttagagaagtagaagaggaaccctttttactttccaaataggttggagagaaggcgactgtattagtggaagttcgataactaactgattgaggtgtagttcttttaatgttttgcacgggtctcagagtgtttttttttacggtggttgcaaagggatcatacgacgctgaaggacttttcagggttggaagatttttgatattcctaacgcctaatgctgcaccagcgctgcccccatcgtttgttccaccccaatggcccctgcctattgacattgaaagggaagaatcactagataaagaaggtagtgaagtttgtcgtgcaagggtttgctctctttgttcatatatggcgttcagattattgtatttggaggagtttttgggaaaggtttcagctaagttatgaatcaataaatatacatccgcatttggttttgtgaataacaatttatatgattccaataatttttcagcacttaagcgacctttagaataatcttcgttataagaagaaaacttattgaagtcttctttggaattttccagatagtattttgctctttctgccaatcttagtctactttcctcgggagaactagcagatctcacatcagttctagagccggatgatgaacccggtagggaagatatagatggaaggtcgtaatcatctctttccctgatcactctagatggagccgagataaaagtagaaagttctgactggaaaaactttggctttcccttcaggatattaccatgctcctgcaaaatgtgggcttgtaactccaactcgtctttaaatacgacaaacttgttatctaagcaagtttggacggtgcaaacgtaatgcgaatgtttaaagtggtcaaaaagctgattataatccttaaagtattgaggagaagcggggttcatcttatcacaaatatggcacttttcatgctgatttctcatgtgaatgtacaattcgtcgtctgaataaaatcgttttccggaacagaaggcacacatagggtggcctttgaatccttctgaattacccttagtttgatggttgcgtaattgattttgggtgaatatttcaagctcacaagggaatgcatgcttatgggttgcacatattaaacagatcattctgttatgttcagatttcaagtgttcattatatttcttgaaactaccaaagtcacaaacttgttcatccttcgataggggacaaaaaaattttaaaagatttagtgtttcggtagcaacctcttcgctagtgaaatttattccatatttttcatttttttcgcaaaagttatatttatctgaaatatcaccatctatgcgatcggtaaacatgacttcttcattctccgttctgcaaatcaaacagcttttcttgttgtacaaagctcgttgtctgaaaccacagatatggcatgtcttatgatggcatggtgttagagatacgtatgttaacttgcgcgcacaaattacacataattcattttcttcatcagtatcatctgcgcttgaagtggtgaggttgggttcagcagaaaggttatttttcttttgctttcttctgaaattcttcctgtcgttgtgaggttttgtattattttggggcccttgagtacgacggaagttacgtgtcggagtaacgttttctttcactgattcgctcatcctaattcttgaaaagaagtatagccactattttttcgacgaaagagactgtatcaaaatgcactttatggatctttttcagctaggtatgcgctcgacgatttgttgaatatggctgagtgggcagtcgttcagatgcccttttcaaaatcttaagagaaaatcagaaaatatagctattattaagagtgaccgcgagtatgaaactttcagtgtaacctttctttattcgagataatgcttaattacaagtcttccgaatatctaatttttttttttttcatttttaaatttcagtttttaccgcatgcttttaatgcagggatatgtataacgaggtcactccgtcacacatgacagaattgcgttatagtgatacaaaggtttatgtaactaggtagaaaaatcgtcattaagtttatttttagaattcagatcgatcactgtgttaatatgagttcctgaattgtactcttgcttctacatctacgctgctttttctagagaccagaaatttacgatcccgtcgtcaccgcctgttgcaagtatagttttaccatttaactccaaccacttcacaacgttgatttcataaactccatgacataatgcacgtttagcaaaaactttccattctccgtctacttcttcatagaccgctagtactccatccgctcctacactagcaatgaggccattaaagccccatgcaacattgtatacctgtcttttgtgtacatccgggagaatagcttcacaaacccattcttgttgatcatcctcgtcgtcacccatgtatttccatacccgtacagtggaatcgtcgcttccactgcacagtctaaacacgccctcagtcttgtcaaaatcagaagaccaaacagttccttcatggccatttaagacagcaacacattcccagtcatcgtcatagtctttccatatcctgacggtgtcatcataagaacttgaagccagtaatgcttcagatggatgccatataacatgtttaacgtcttgtgaatgttcttgcaaaacactaatacactcatattcctcgccactttcatctgtttcccatatccacacgcttttatctctggaacaggttgctaggtaatatccatcattcgaccacgctacaccttttacttcattttcgtgaccttcgataatagctagcaggtccatctcgaaagttctgtcagcagattcttccttagcccagatagatacagtggaatcaaaagagccagccgctaacagcgaagtgtgaggtctccacgccacagatcgaatcgcctttttatgagcagtctcatctagcacatcaattaacgtaaaatcgtcatatttcacgctaactagcttaatttttcgatcagttgaacctgttgctaatataccttgagaaaagtcaaaagaccatatcttttccttgtaaagtttcaaagacttaatcagattgatagacgccattaccaaataagtaaaccaattgaactattaaaatgtcgtggtatagcccgattttgatttgtgatatctacaaatctagtatttattcgcaattaatgaggcaaagacgatacaatattcgatgtgagatttttcaaaacacggcccgctgagagcagaaagttttagatgacctatttgaaggcaatcacgatggtatttttcaagaaaataaatagtagtaacactgctatgcacatcagagtcagattccttaaattcaaacgtttctacaattagtatgaccttttcttgaagatctttttctccttataaaggcaacacaaaacaagatagaagtgcaaaggtattttttgtttttcacgtgataaaatcggcttcgagaaagtagaaaagggtattatgatttattacaggctacctgcaccatctcaaaggttttacgttactaaggagtgaatcaggttttgataaatatttacactatcttttacaaggaagatgtcgaataagcaggcggttctgaagttaatcagtaaaaggtggataagcacagtgcaacgtgccgattttaagctgaattccgaagcgcttcatagtaatgctacggtatttagtatgattcagccaactgggtgtttccaccttggtaattatctaggtgctacacgtgtttggacagacttatgtgaattaaaacaacctggccaggaattgatatttggagttgctgatttacacgctatcactgttccaaagccagatggagaaatgtttagaaaatttcgccatgaggcagtagcaagtatactggctgtcggtgtagatccagaaaaggcttcggtgatctaccaatccgccatccctcaacacagtgaattacactggttgctttctactcttgcctcgatgggattacttaaccgcatgacgcaatggaaatcaaaatcgaatatcaaacaatcaactaatggggattatctggttaacgattctgacgtgggaaaagttagactgggcttattttcgtatcctgttttacaggcagcggatattctactttataaatctacacacgttcctgttggcgatgatcaatcgcagcatttggaactaacaagacaccttgctgaaaagtttaacaaaatgtacaagaaaaatttttttcctaaacctgtaactatgttggcacaaacgaaaaaagttttgagcttaagcacgcctgaaaagaaaatgtccaagagtgatccgaatcacgactctgtaatttttttgaatgatgagcctaaggcaattcagaaaaagattagaaaagctttaacagattccatttctgataggttctactacgaccctgtagaaagaccaggcgtatcgaatttaattaacattgtcagtggcattcaaagaaaatcgattgaagatgtcgtagaagatgtatctcgtttcaataactatagggatttcaaagattatgtttcagaagtgataattgaggaattgaaaggcccaagaacagaatttgagaaatatatcaacgaaccgacctatttgcatagtgtcgttgaatctggcatgcgcaaagcgagagaaaaagcagcaaaaaacctggccgacattcataaaataatgggcttctgactgtccccggctttaggctgctgcaaacgcaatgtaaataataatacagtttaacttgtacgtatctttgttatttcagaatatgcaagattcctcactcggcagatctcatcaataaacgttagtatcttgaaaaatacgcagatgttggtacagtctcttgcagagggccagcaccgttagaatgttgtgttgccaccgtctggctcgaaaacaggtcgatctgtgtaagtattgtcctgggtgcagttatttgtagtagcgattttcgcgggcagtggaaaagaacgggtgcagtgcggcgatgagtgcaattagctgccgaagggtttgcaccggtgattccgagaccttttgcacacacttgtatatatttagggaagtcacggtaactaatggatttcttctcaaatttgagacatatggattagactttaattctgcctggtactaagctacttttcaaaggtatttgagatatttcgtaaattttgcggccaaggagttgaggtgtttaatacttaaaacgaaatgagagaagtgatacttgctgtacatggaatgacatgcagcgcctgtactaatacaatcaatacgcagttacgagctttaaagggtgtaacaaaatgtgatattagtttagtgactaatgagtgccaggtgacatacgataacgaggttaccgccgattctattaaggaaattatagaggattgtggatttgactgtgagatactaagagattctgaaattacagccataagtacgaaggaaggactactgagtgtacaaggtatgacctgtgggtcttgtgtttctacagtcaccaaacaagtggaaggcattgagggtgttgaatcggtagtcgtttccttggtaacggaagagtgccatgttatttatgaaccgtccaagacaacgctagaaaccgccagagaaatgattgaagactgtggatttgactcaaatattattatggatggcaacgggaatgcagacatgaccgaaaaaacggtgatcttgaaagtaactaaggctttcgaggacgaatccccactcatactttcttcagtaagcgaaaggtttcaatttttgttagacctaggtgtaaaatcgatagaaatttctgatgatatgcacacactcaccataaaatactgttgtaacgaactcggcattagagatttattgaggcaccttgagaggaccggatataaattcactgtattttccaatttagataatactacccagttaaggcttctctctaaagaggacgagataagattctggaaaaaaaacagcataaaatccacccttttggctataatatgtatgctattgtatatgattgtccctatgatgtggccaacaattgttcaggaccgcatattcccttacaaagaaacctcctttgttagaggtctgttctacagagatattttgggtgtaatattggcaagctatattcagttcagcgttggtttttacttttacaaggcagcatgggcatctttaaagcacggttcaggaaccatggatacactagtttgtgtttccactacttgtgcatacacattttctgtgttttctttagttcacaatatgttccatccctcaagtactggcaaactcccaaggatcgttttcgacacatcaatcatgatcatttcatatatttccatcgggaaatatttggaaactttagctaaatcacaaacatcaaccgcactttctaaattaattcagctcactccatcggtgtgttcaattatatctgacgtggagcggaatgaaaccaaggaaattcccatagaattattgcaagtgaacgatatagtggagattaaaccagggatgaaaattcctgctgatggcatcataacaagaggtgaatctgaaattgacgagtcgttaatgacaggcgaatccattttggtgcccaagaaaactggttttccggttattgctggttctgttaatggacctggacatttctacttcagaactactaccgttggggaggaaactaaattagcaaatattatcaaggtaatgaaagaagcacaattgagtaaagctcccattcaggggtatgcagattatttagcctctatttttgttccggggatcctaattttggcagtattgactttctttatttggtgttttattttaaacatctcggctaatcctcccgtcgctttcaccgcaaatactaaggctgataatttttttatttgcttacaaactgctacttctgttgtcatcgtcgcatgcccatgtgcattgggacttgccacgccgactgctataatggtgggtacaggggttggagctcagaatggtgtcttaataaagggcggagaagtattggaaaaattcaatagtattactacttttgtttttgataaaacaggtaccttaactacaggttttatggttgtgaaaaagttccttaaagattcaaattgggttggaaacgtggatgaagacgaagttctcgcctgtataaaagcaacggaatccattagtgaccatccagtttcgaaagcaattatacgttattgtgatggtttgaactgtaataaggctttaaatgccgttgttttagaaagcgaatacgtgcttggaaagggaatagtctcaaagtgtcaagttaatggaaatacttatgatatttgtattgggaacgaggcgctgattttggaggatgcattaaaaaaatccggatttattaacagtaatgtcgaccaaggaaacactgtatcatacgtatcagtaaacgggcatgtgtttggcttgttcgagattaatgatgaagttaaacatgattcttacgcaacagttcagtatctacaaagaaatggatatgaaacgtatatgattactggcgataataactcagcagcaaaaagagtcgctagagaagtaggtataagcttcgaaaatgtttacagcgatgtgtcacccacaggcaaatgtgatctcgtgaaaaaaattcaagataaagaaggtaataacaaggttgctgttgttggcgatggcattaacgacgctcccgctttagcactgagtgatctaggtattgccatttcaacaggtacggagattgctattgaagcagctgatattgttatactgtgcggtaatgatctgaatactaatagtttgagaggactggccaacgccatcgatatttcactaaaaacgttcaaaagaataaagctgaatttgttctgggcactttgctataatatattcatgattccgattgctatgggtgtgctcattccttggggcataactcttcctccaatgctcgccggtttagcgatggcattcagctcggtcagtgtcgttctaagttcattgatgttgaagaagtggactccaccggatattgaatcacatgggatttcagatttcaagtccaaattttcgattgggaatttttggtcaaggcttttttctacgcgggctattgcaggtgagcaagacatagaatcacaggccggactaatgtcaaacgaagaagtcttgtaaataacaggtaagtctaatttatttaaaaaaatccacgagcatatagatttataacaataataataattaatattcatcaattttttagtaaattcatatattttactcctactctatgtattttcagtaagtctactagtcgtattacccgtcggtttcaagggatattatggaggtaataaggatttttttaccgatttaaaaacccattatatccctcttagaaaaattttagtattcttagataagttgctagatttaccaatatcaaagggaagactgcaggacaacacaaaaacacaagaaaaggaggacaaaaaatgcaggttaaatcgattaaaatgagatgggagtctggtggtgttaattactgctatctattgtccgacagtaaaaataaaaaatcgtggctaatcgatccagcagagcctcctgaggttctgccagagttgactgaggatgagaaaataagtgttgaagcaattgttaatacacatcaccattatgaccatgcagatggtaacgctgatatcttgaagtatttaaaagagaaaaatccaacttcaaaagttgaggttataggagggtcaaaggactgcccaaaggttacgataattccggagaatttgaaaaagttacacctaggtgacttagagattacttgtattaggacgccctgccataccagagactctatctgttattatgtgaaagatccaacaacagatgagcgctgcatttttactggcgatacactatttaccgctggttgcggtaggttttttgagggtacaggcgaagaaatggatatagctctgaacaattctatcttagaaactgtgggcaggcagaactggagtaaaacgagggtttatccaggacacgaatacacaagtgataatgtaaagtttgttcgtaagatttacccgcaagttggtgaaaataaagcattggatgagttagaacaattctgctccaagcatgaagtcacagcagggcggttcactttgaaagatgaggtagaatttaatccattcatgagattagaagatccaaaggtccaaaaagctgccggagatacgaataattcatgggacagagctcaaattatggataaattgagagctatgaaaaaccgtatgtaggaaagccaacagagtataatatacttaaaaatattcttttagcatacccttttatttcaatgtataagagtttttggaacgctactttataacattcaggtctgttcactagaactcttgtagttgtgccgtcataaaaattagtcttcgcgtggctgaaagaaaagttccaataatacgggcggctcgagtagagtaatcattgccgtcacaaaaccattttcgggtagaaataaagcaatggatatttgagctccagaattaaaatggctttccttttgcggtttactatctacttgactttggctggtatttaaacacaagtaagagaagcatcaaacatgggaaagaaaaatagaaagggaaaagaaaataatgctgctaaaacctcttttctaaaagtagagaatattaaaaacactaattcgggattggagcttccatcgcaagactatacaaacgttgaagaaaaagaaagtagcccgaaaactgactttccattaattacaaaggaacatgtaaacacgaaaactgacagcaatattctcgattatcccaccataggcgatttagtttcctcagtagagaaattatgtgtcttgaaagaattgaagatagcatttccagaagtagatgatacattaattaaagccattttaattgcctcccaaggggttttggagccggcattcaattctttactctactactcaagtccggaggaaaacactgactttgcattaccaatgaagccgataagtgtggaagactatagtaaaataaatgtgtctgagattttgcaacgtgaaatattcgatgatattgaagacgaattttctggtcaaggaataaatggctccatggtaatttcaaaaattgaatcagaactaagttctttggccgaacacattggcaacattagcacccccggatcgaatagagaagtcgccgaatcgactaggaacgtggctgttgcagagggccataatacaattttatcaaacgaagatagtatactcaagggaaaagagaagggaaaagaggaggaaaaggagaagggagaagaaaagggagttaacagcttaaaaggcgccgctgtgaaagttgttgcgaagtcattgaagaataatcgcattcccgtcactgtgaagagaaatgagccttcaaacaatttatttgacgttttaaactgcgacgaaagcgaggaagaagaagagcaagatgtcgaaaccaatacgtcgaatcaagaaaggaagaaccagggcggtaatactgaagtgccggaggctcagcgtgacagtgcagataggttacctgccaaggacgacggtggatacaaatctgcctttggcactgatagttgtggtctatttgcagctgacgctaaagatgaaaaaaagcaggttcatccatctagacaagaattaagttttacgtagtgtatagcggtaatgtttattaactctttcggcaaagtgcgtttgggctcgcaatgaacagacaccaccattgcttcttctgcgcttatttgcctttgttgtatatctagttctcaaaatggagtcattcatcagtcgatgtgtgggcggaaatgacgttcatctagcaatggcacactagtttttactcaacaattcaaactcaatggaaagccaggaagttagcgccgggaaacttcaggacaatataaaaacaggactaacggaagaaaataatgtgggcctttttgagcaacgctgacggtaagtagtttcctacgatcgtacaatcccggaaaattgtagtggtgcaagaagggaaaagaatgatggcgaaaaatgcacgcgcgtaaataatgatttgtcgagtcctattgaccacaaaacccgcggaaacctagttagcccaaaaggaaatggatagcatatgaaaaacgaaacgaaacgtccttttgcacggcagaaagagcttagtaggacccgggacaaatgcaagttagattccttgattcccgaatgctcggtcttgcgtttcgccgtggctgcatggaaggtcatcgtacgggtacgggcagtctggctgagtggtgccgccaaagtgcaatagctgtcagtagggcgtgaggaatgtaaaaggcaagaaaacatgtacgagggaagagaagggggcaaaagaaagataataggaacggtgtagatgaactagaaaaggttcaagagatgataaacgtgaagggagtgtcatatctaccgacataaagatagagatctttttttttcctttatttttttttttgatttttttttttgattttcttgatattagtttttagaagtcctttgacggggcagccggagaatatataccaacggcattctattgtctttttttcttccttccttgccaggcatctgcatccattattgcctttagttacaatgttttttttcccgaagcttagaaaacttataggttcaactgtgatcgatcacgataccaagaactcatcaggaaaggaagagatcatgtcaaatagccgattagcacttgttattatcaaccacgcctttgataaggtactatctttgacgtggcactgcgggatattatccgaaataagatcaggactgatgttaatgtttggcattttccagttgatgtgctctttgggtgtcatcgtattgctgttgcctattatcatactggacgcgatcgatctattcctctacatgtgcaggttgcttgattacggttgcaagttattccactacaatagatcatcattaccggtggcagatggaaaagaaaagaccagtggtcccataagcggaaaggaggaaatagttattgatgaggagataattaatatgctaaatgaatcctcagaatcattgatcaatcatactacagctggtctggaatatgatattagttcaggtagtgttaacaaaagtaggcgtttgaattcaactagtacagttacatttgtgaagcagaataaacttgttaatgaaaggagggaagacgcctactacgaggaagaggatgatgatttcctatcaaatccgaattatgataagatatcattgatcgaaaaatcattcacgagtcgttttgaagtggcttgtgagcagaaagctgcttaaattgataatcaaggtcaaggcaacgcaacgccactgctaagaacacttattgctacagaaaggaaactaaaaataattataaggctagagagaaataaaaacaaaataagagagataatatgggtaagggtctgccacccatctgataaaaggctgttctatcttttggaactctacaacacaggtaaacggatgatactggctatatttatatagataaacaaacttgcaggacagatagttaagcgtctatatcatgtgtattttaagcgaagaaaaaagtacaaaaatgataaaaggcaaaaaagatgagaagttttttttgtgataaaattaattattaaaaaatacacacgtagttaaaattaacagcgggggaggaaaccttaagagaaagagaaacaaaaaaaaagaaaggaaacaaataaaaatgagggtgacccgaacatgttgataccgtttcctaatactgcttccttatttcatttgatagttactttcgtttattgaatgagcttaatcttgtaggacaatgtacaaggcatatagcatacctgggaaccaagccaaaatggtcaaaatgatatccactatacagtcagtaccccacccacgggctagaaaaacggcgactggtggtaagaaaagggataatataatgttaatgatcttggcagaatccattgttgtattgtgctgtgctgtttagttcaaaatgtataatcaattgtattatactggcgaaaaacaacaaccgatagtaaattttcttctttttttcctttccctcttccaaaacaaaaacactcacttcctcttttgtatttatagaggcgcccatcgcaaaataaccaggacccccttttgagggcgtggttaaagggcacccagagcccacacccattgcatcttccgctattaggggactgcggaagtgaggggagcagtaaatagtgatctttgtaattttctgcaaaatccctctcgctgtctcgggtttttcgattcagaggaccttcccccccccatgttccgagatcggttttggtggttagaaggccggaggaaagacatttaccgcttgcgcgcggcttcttctgtatgctgtgctcaactaccaagagaaggattacgcgcacggatacgttggatgtctgcgattggtgatgctaagaactaaaggtatttcgtcatcgtatggtttgatcttcgctacccttgactctttactgcgataacggtaccacgttcccataaaattcttattactaaatctctataaagctgcaacagctagtttgtatatataaatcattggcgcttcttcctcaattccttgggaatttggagctcctctattaaaactgatgtccatgggatagtattgatacaatcgaagagtctccaaaaaaaccatcgggaaggtttctttttagtatcttcaggatactgaatccggctgccaatccaatcctaatctttggtaaacttgtgcctgacattgcgaccatatcgtagccttttcttctttagataagctgactttgttttttccctgttgatttgttgcggcgcttgatctcatcatcaattcatcaaggttattattggggtttttcaactgaatgttcttcaataaagcctttttcagaagcgattttgtttctgtgctgtttttccgcggtattatgcttggtgggggcatgtccggtctttttaagttggactgttgtaacttccatttcttatattcggagcatctttgtttgaaatcaaacctgcattgtgcctctactgctatatttaagaggtaattttcgatgatatttctccattccggtttcgacaaattcatgacggcttcatttctaccagttatatgctcatgtctttttctagcggtcgctactgtatatttggcgctggttagtttgaattcataatctaagttagcctccatgtacagatccgaatggactaacgttgcgattatggtctcatcgctagaatatagtggtaataattgtaacctaaactggggcatattatcacccaccgttattacttccggtagttgattaccccattcgggccttaacttctcgactatcaataacgatcttatatcgtttaaatcccaatccaataactctctcttggtaaacttgggacgcccgttacagagaatgttggatgggtctgctaatagaatatctggcgaatacatgtcataaaacgttttgggtaatgcttcatccaggctcactctcgtgattaacttgtggttaggaaattcggagaacgaagagtcattagttagttgcgtgtgcacagtagagggggcagaaaatatacttgattgataagacgaggcattatccgaaagtaaactcccactttcagccacgcttgatctcctgctcgctgaatgcatactgcttgaatgatgtgaccttctgctaggtgaggaggccaataatctttttttaatctcatctctagctctatcagtgtactccggaggagcattcacaaagttctctcttctcgaagaagtcgtggattgagagctactcattgatagtggcaaactttgaaaagaagcattatcactgccactcatcgtgttttccggaatggcctgtagggagcttgcaaacccatgattactgttagtcgattctaatggacgtcgttgtaaaacttggtttttcgaagttgctggtggtggtgaaacaaacattcctttgagtgtgtgtactctatgcgttcgaataaaattctctttgtattgctgcttgtggtttcgctattgagaactttcaatatacgttaaaaaatacttggagtgaaatgaacaaatctttttgtatgtttccttaagttattaaaaaactccatgctgttttttaataaaaaaagaagcagttacaggcgcattacaaagtttgagaagaaaggaaaaatgtcatttggttatataaattttttttcttaatggagattgaggcagcaataaaatgtgggatgaaaaaaaaaaaaaaaggcacttgaataaggggtagaatggcagatattccatgtctacggtagtttcactggagaaatggactcgtattttctctcacgatgaatttttccacaaaattataagatgaggaaatgtgtggggcagtcatcctaacaaaactcgcacggactccatttccccggacctttttcccgcttgttctagggaataatttcggaataattttagggacttcatagtatgactgggtttcaaggaacggaaaaactggttagtaccgcgttattctgccatttgctgatcgttttagtggaggagcggaggagggggcggggtgataactttttttccgctttacaatagagaaaagtccaagtaagtctcggcgtgagatggccttgatgttattagtaccggcggctccctaatagtttactaatacgcataccttatgtcatatttttccatcaaatattgatcagtagaaaaccttggcaatgtacatagagctacacttttttggatatggagtattagagaaaactgggtttggtgggcgaagagagatgttccctacctcctcaagagtcttcaactatgaatttcacaccatatccttatctaaacgaactatggggtggtcagctaacgcaagtattgaattctttctcttaaagtacccctaagttgaagaattcattttaatcttccttgctttgtcccccccccctagaagcatagttttgtcttaacgctgtaacggtcttgtatgcttattttggtggtagggatcggtttgcaccttggaaatgctatgtttactttattaaaaaaataattagttttcctccaaaacgtaaacaaatataagtttgagagacaaagaaaagaatgaaagagtcttatatatatataagttagctggtagcataaccatttttctcgacttatttataaaacattcgacatacttccatatttcaagcattaatatgagacctagaattttttcaagctaacttatgtacattgtagttatatgatgaggaaaaatgtacacaacagcttgtgctgtttattcccatcgtatgttgcggtaatgcaaacagcaatagaaaaaaaattgatataagaagaatatgactagtagcatcacagtgaaacagtaacggtaaatgaatcagcatgtgaatttttctagaaaataaaaaagaaactccgaagcggggagtcgaaccccggtctccacggtgagaacgtgatgtgatagccgttacactacatcggattgtaccttggtgatagtttgacctaaaagaaacgttcattatgtaatgaagaaagccaattattcggtcgcaaatcaaggttctgttagggaatatgattttctttgactctcaatgagttctcttatgactatttaggggctaaattatttgttatggcaatattattaggtaggaaagatacgactttactgaaattgttggaaatacaaaaaggagcagatcattccacataatgatatcattattccctctttcatttaaaaaatcaccgtttttattttattaattatcagtctctgcattttcagattctgttaaatttgataaatgtttttcgccgtttataaagtatttttgcatcatgtatgataatgtattagtaatatgaaaactggtgttattaataatcagtggtcaggatgtagtattagtttggaataaaagcaaatctcctcatgctatataagaggaatatagaaaatacaggccagttgttcttattaaacatgaacataatagtgggtctagcagttactatacatttaaattggcgactactattattcgtacattcgactatagcagtatttccaattaatggatctttaactcagctattatactgtttgagttcctcgtttaacatttccctgtccaacagggacttaaaagtatgtagggtttgcattaatatacagtagagacacttaaattgttactatagtaactcaagttactattcgtgagaatattgacttattattcttcatgaatagtcgattagtaatcaaatgaagtaatcagatgtgcaatgcgtctttaatgtttcagactggagaatgatacgtagctacataataatctgggtacagtaaactcaatgatctattacctgaatgattaatctgatgcttgcaatataacaattcatctcgtgacattaaccataagaattactctcatcattgctatatcggcaaggtttaatatgtccagtcggagtgtattttatatctctttcttttagaataagaatatctgcttttattcttaatcaatactacaacctaactactaactatcaacactgttaattacgattcgctccaacaaatttggttttgtggattcttaaattctcgagaaaaacttctaatatatcttgtataccagatactgtagcctttagcaacgatagaatacgaacagttctcttaaaattcgcctatttctcataccgttgcagatataactaaagtattgacattcagtgacatctggcgctgatatcattatttaacacacgtatgtttgcgtggcattgtcatttttaagagcagagaaagaaacaatgagctacttgagtgtgacaagttgaaaagtccaccaatttcacgttgaattaggattcatatatgaaattctagtcattaattagaattgtaagtttctgagcttttttttcctagtaaattaaacttgtctaatacatccagttgtgatgtattctatatctcagttctacagtagcacgaagtttcccggcctctctattcaataaattcagctatcgctgattatcaacagcagcaacgaataaagcataaaagaacagaaaaattcttctacaaatttattctgtaaagattcagcttctttcgtgaatttctaagttcatgaggggaatttaagtatggcgtttcttcgtagcgccattgtcttgagccaaaatggaactctaaaaattttcacgacattttactagtcagtaaagtgagcatatacatataagaagaaatttcaaaaggtaaaaaatggagcaacttccagctcattatcttttcaatgttgtcgatgccatagttggattatgaaatctcatattcataaccacaacgcgtttttttccttttaaggcactacagactccattctcacaagtttgtcaaaagcacgagcgcgatgagaattaaagtcagatctggttaatgattctggtacaacagcagaaacaaatcgagtacaaatttaatcttattctgtcgcaatagttgactttcttttctggcctctcgaacaaaaagcatgaccgtttccaacattgggggggaagaacgactaataattttaccagacgattatgaaacttcgaaaactataaacacttttacactgccgccaccttccaatattacatccaaacctcgtatcgagctcttcgaaaatattaatggaaaactttacgaaataagatcttttcaattcggcaaagggccctcgtattcacatgaggaagatttggcaaatgataaatatcactatactaaggaaaatcacccgatcaaatcaactttcattgtaaatacgtctgatcccaccgatggttatgtttttaactcaagcaaaatacacttttgttctttatacgatattgcttttagtttgattggattttactatagaaacagtgtttcagcagatgaacaagattactccaattcaagtgatactggtgaaaaccaaaaaagcaacagcaaaaccaatgagaaatttcttacggtgcgtgattaccatgatttcttaacggataaccatgacaagaattgggaaaacatttctttaagtcgtctcaagagtggcttagcaaaagttagtgaaaccattgaggaagctggtgacgtctattacaagatcacatctgcaatgataacacaatttttgttaggcaaggtatcaaaaattgtagaaaactttcctccaagtatccctacacttaaaaatgccccaacggaaataaaacagtgctacaaggtagttatggctacaaatcttttagtttccctgattccaagggcggcctaccataatttacttaccttttcacctacaatggatagtggttgcctaaatccggatataaaagctagcttcatagaactcgaaaactacgagactacgaacgaattacagaatgctgaaagagaattactgatgaaaagtgccatgaatgtaggcctaaattcgaatggcagggtttcattgccagtgaaaaaagttaccaaaaaaatagttcaaaataaaaaaccaaaagtagccataggaaaaggggccattgatggattttttaaacgtaagtagctagtatcataattaaacagcaatttgaatgctataactcggtggtgatgacctcagtgcgagataattacacaatattgtcactaccaacgaatgggctaccttttttttcctttctcgaattcaagaaaaaattaacaacttttccctcgatgatgttaacaaatgtctgaatataaaggaataggaaacggttgctagattgtatttaccttaccaactttcaagttttttttctaacttcctaactttcagtctcgatacattaatcaacaggacgtagtgattgcaaaattgttcagaatatacattagattaaaagacaaatggccaaagacattgagatatccgcatccgagtcaaaatttatcttagaagcactgagacagaattataggttggacggccgctcctttgatcaatttcgtgacgtggaaataacgtttggtaaagaatttggtgatgttagcgtaaaaatgggcaacaccaaagttcactgcaggattagttgtcaaatagcacaaccatacgaagacaggccatttgaaggattatttgtaatatctacagaaatatctcctatggctggttctcaatttgaaaatggaaatatcacgggggaagatgaagttttatgttcaagaataattgaaaaatctgttaggcggtcgggcgcattggacgtggaaggactatgtatcgttgctggcagtaaatgctgggctgtgagagctgatgtacatttcctggattgtgatggtggatttattgacgcttcgtgtattgccgtcatggcaggattgatgcattttaagaaaccagatataactgtccatggcgagcagatcattgttcatcctgttaatgaaagagagccagttccactaggtatactgcatattccaatatgtgtaactttttctttcttcaatcctcaagacaccgaggaaaacataaaaggtgagactaactcagaaatttccatcattgatgcaacattgaaagaggaactactgcgagatggtgtattgacggttacgctaaacaaaaaccgtgaagtggtacaagtttccaaagcgggtggtttaccaatggatgcgttgacgctaatgaaatgttgtcacgaggcttacagcattattgagaaaataactgatcaaatactgcagcttttaaaggaggattcagaaaagagaaacaagtatgcagccatgcttacatctgaaaatgcccgcgagatctaatattaacgaaaaaactgaaataaaagcaacgcttatacatatacatgcatgcattaatatatgtatatatatcggtacgtatagattgtaaaattacacttactactaaaggcagtatgaaagacgcccgcagtttttttcctactgttttcttgactgcggtgttcaaaaacataaaaatcattaaattactataaaacaaacgcatactgcgaagaaaaaaggctcggctataaatgcatatgagaaaatattatcttttgcctccctgcttaatttctgaaggcatgtactatccaaaagaaaaatcttgaaagaaaacaaatcccattattcttattattaaaacaaaaacttcgtcatcgtcatcacataaaaaagacctaccattgtcaaactgtacaacagcaacacaataataatgacgatgatgagttcctcgagaaaccctagaacggcgttataacactgtttgagggtattactttttccactactctcgtggcgcggaagacctgcttccaaatctactgtgtaatcaatacacttaacctcctctctctccccttgtgcgtcagaaaactctgcctgtcttatttccttctcctgttgtcctattttcagtacatcatcgatgcacctcgaggtatcttccatcttggtgtcaggttgaaaaacaattgctgtcgtttttttttagttcaacaagtttggtatggcagttgacaaaaattctatttgggctgcaatgaatcaaagtgtacaaacatctggtgaaatcgttcaagttttatactgaatagaaaacaaaagataaggttctgcgcatcgcaaataataaattactagcgcgccatacaagagacgagtctatttttttccgccagacgacacaaaaaagaacccgtgcaaatattatatcccacctcccacgtgtcagcgaagctcggaactgcgtaacattatagggcagaacatccaaatggaaaaagtaataacactatttgcgatgttagtggccatcctgcgtcgttcggataggttaggacgggctgatgaatatacgggtgtaataaaaatgacaccacgttatcagggttttcatgacagtgcaaactaatatatgtcatattattttaagtgggctcatttatttacatgtttattttttattgtaatttgcgtatgtatcattacacgctaatgcacatttgcacgttctaataatgaaggtcgtccgtcataagcaattaggaaatgagaaatcttgattttatcgctaaaaaacgctttctcttgtggcaggagcagatctcttacatatgtagttatttagtcgcttctaagagccagatcaggtgcgtggattcatataatatccctttttcaataacaacgttataaggaaacgttgggtaaaagaatattaattactgagtggaactttttctcattgttctgtgtatatacaatgttgtatctcaaaatgagatatgtcagtatgacaatacgtcatcctaaacgttcataaaacacatatgaaacaaccttataacaaaacgaacaacatgagataaaacacggccttccctagctgaactacccaaacgtataaatgcttgaacaatcagtttagatccgagattccgcgcttccaccacttagtatgattcatattttatataatacataagataagtaacattccgtgaattaatctgataaaccgttttgacaactggttacttccctaagactgtttatatcaggattgtcaagacactccggtattactcgagcccgtaatacaacatacaaaagtaactcttatttacaaaaaaatctcttactttgtagcatctagatcatcattcgtgggttctgagcagtaggaagaatatttctggtagaaatgataaatttcaaagcacagttcgaaagcaatcaggtatataattatccattccaaaaaagtgctgtttctctcgtttaaaagagagatgagggctcgacactcgtccgtagaatagtccagcttgctgttcagaatatttattcttgggcctatgtccaaatacctcgaaacatttttaaaaatctcttccaattgaggttcactccaataaagatcaggggtctcaattagttctgaatagaggttcaactttcctctaattagaaaaaggcggcctattgactttaatgcatcacttgaccttagatttaactttgttcccttagaaatattttctgttattgttctggtctttgatatatgtttttccattgcttcttctaggactgccaagttggtgcttctcgatagcccacttgagaatgccgccttatctagcattccttgatcagaatccaaggagttaattattatcaaatctccagaaagaaagctttcgcatgcaattctcggtgttaccttattatccaaactggaaagcttatcaaaatcttgttccccttctatttccacataatccatgtcctcagtctcaaagtcttctccgttcagtggatttaaactcgctgctttaactataggcactatgcagtttcgaacactagattcactgaagccccagcttacaatagatccattttgacctaaaatcattacgtcacctttattgccattatcctgataactaaatgacacgatttcatcaggtatcaaatttgtcggttgtaatccttgcatagtaagcaatttcatgcatcttttgagatcataaccctctccggtggtaatggtgatacaactcttcacttttaagtgatctttacttaaagaatcctccagaatatcacgtccattctcctgctttctgtggtttggcacaaaacttcgtctcaaatagcgagtagaattcttcgggtttttaagcatcttcattgtcttgatattcgtatccactgacttgtgttccctattggtcttcttctctgtagctagtttacctttccaacggccatcttgcacttctaaattctgtattgataaactagttcctaaccgtctaatttggaatcgtgatacgaaaccgaatgtgctagtcaaacttctgaatgaaagcattcttcacgccatattatgatcatttattaaatgtctcccgtaggagctagaggagcctcacacaacatacgcacacatttatattcaccgaaaaattaaatacaaaatggaaagtagagaaaggagagaagaagtagaccatctcattaaacctacatttgtctttagtatcaggaatatgtataagaaaggtgacctaccccctttacaacggtgaattagatgaatcagctagcctaaatatagtatctaagacattgtatatactttacctttaactgatgcgttatagcgccgcacagatctttaaaggcctacctctgtaaatcgataacagatgattttccggttttgtggcagtataatattgcccacctattccctttatgagcctctttggagaggttattataaatgctcgtggcaaagcttctaggagtcgagttattacctgacccaaaaacttttctcagccattcttccttctgagccaaagaagtaattgagattatttctaaagtttcatctcttaaggcatcaacagtgataattggtgcattggataaattgtgtaatatcatattcgaagaatttctggctgcatcctcataaacccacttttcccttttattagctttcttagatcttgtagccatgtttggaacataaattaccttttgattattagtcgaaccagcaacaacatcatctatgtcaccttcttgactactaccggcactgctgttttcatcccatcttttaaattcatcagccttatcgcccaaagtgagactatcgttgatcaaagatttattaccagtttcttgttggtacaaggttaaaaactcatcaagatctaaatctatgtcaacattagtgctcaatttttttatttttaatggcttgtactttctcttgtgattggttagtggatacgcttgttgcttaatcagcaaaatccagtctataccatcctgttgagcgccagtaacgacatcatccaccgaggaacaatcccttaacatatccgctttaatgttttgcttccacaatgtattcagtattgtaaccccgattgtgtccaacaaagagttcgaaaaactcgatatcaatacatcacacctgcttggcttccaatcaacagctgtatctttcaaaaacctatttctcttctttatcctatttccagaagcgagtttgaaatagttttgggctataccgaatattgtttcccacgctaagttgaaacctacagccttacgagtattgctgctcttttttcctgatggtctggcaaaaaaggatatcaaagtgtcatacctccctccagcagctatcatattacgtgaggatccatcgtcataaactgcatgaaacatgatacctcctttgtaaaaagcgctattgtagttactcaaaggagatatcacaacatttcttgcaacttctaagggttttaggtaactgagaacctttgatatatgggacaaagagtcctcaattttttttagatgcggactatcaatcatcaatttatacaggcgttttttggctgcttcgaagtccagtctaaaatcaaataactccaaatcattcaatgccgtagaagatatgttcagttgcgcctttagttcattctttacttccttgaaggaccttgcaaagcctacttgcgacaacattcgtgaaactagaggcctttgggctttatcaatatttgtaaagttgaaaacactctccaaaatatcagcatgatttaatatgaaaaaagtgtttgttttctcaaatacaggaaatacggttaatatttcatcgataattttcaagctttctgcatcataaaatcctgactctgaggaagattttgaaattatgtcgaagtcaatctcaccaaactttctaggttccaaacttgaccttgaatgatcaggaggtcggtaaacgtgctgcatcctatattgcttagaaatcagacttggatttttagatagatacctagccataggataagttaaatcatattgtaactgcaagacggtaccgcccttgtcaagcacttcatatacattctgcgtaccgtatatgggggcctttggaaaaatcctcggaggagcattattttcaattcctccatgtttcctgaaaattttaactacctcttctgtcatttgggacctgagaatgtttgcgaaaggagtggatgttggaactgagttatcaaatagaatatcatttgttagactgtaagattggttaaataaactttctcgaacttgctgttgccaaggggatgaaggattcgacaaactttttaaagcctctttgattacttcatcctgatgcttcacaggaagccaaccactatttaataatgtcctagcaccaggccttttattgggatcatggtctatgagtaaccttataattttcttttcaactttcatcttattatcgtcgaaatcaggaggaaattctatcgacactgatcgtaactttttcaaaatattaactctctccatacctgtactgaaaggatagatcatttcaaaaaaaatgattccaagtgaatacatatcaatcttttcattatagtgacctgtaccatctaaaacttcagtagcaacatacattgctgtaccaatggcggatgttaaattatctgagctgcctggcaaattctgtgaatctagcttaagtatatccagagatctatggacgttcttagctaacccaaaatcaccgattttaacatttctcgattcatctataaaaatattcattggcttcagatccctatgaatgataccctgggaatgtatataactcagtgcttccaaaatttgtcgaaataacctccaatattcatcacgttgttgatttaaattttcagaatggatcaaatcatatagcgttctattttcacagtactccatttgaataaaaagcgtacttttcttcttaacagcagtcatcggttttacaaaattcctccttcttggaacgttctggatactctttgattctttatcagtatcatcttgactttcgctcgaggaagtcgaggaagtatcatggtctagatcttcattttcatcatcacgagaactattttcaaagacaatatccggatatcctgaccccgatatgaaatcccagttactattatccaaatcgtgatttgttctatttttaaaaatactgctttgatctaataaatcattttcctcaaaatcagaggaagattcgctcaagtcactttcttcatcagttgattcaaaaacgttttcatccatactgtcttcttctaaccatgcagcatagtaacgcacaacatattgatgatttaagcttgctaacagcattacttcactcaatatagtagataacttttcttctgtatgtctaatcttcttgatcgcatagtatctgctatcgagagcattacgtgccttgacaacttgtccaaatgcgccctggcctaaaactgcaatctcttcaaagtcagaagcatatcgtgatcgcgttgcaggatttatagaagagaatctggaaccaacattaaatgatcttcttcgtatactcgattgtgaaagtgttctacctccattgccccgaacggttatggtatctccaggagttaactccaaggaattagaattgacactttcggaaactaagttaaatcgattgattgtagagtcaatattggtccttaagaatttcatgggcagtagttctaatgttcctaatcttttcttcggatcgttattaagcattttcgaaagaagatcatataaagtttcatccatacttgttgaatctaggaattcttgaggcgtttcaaaattcatcactatatcagatccactgattatctggataaacaaaacaccaagttgccaaatatcagttaatctttgaggtttggcgttattgaatttcaacaactcaggggctatccatgtacttggagataactcaaccgaagaaccatttttatttggatatctcgatagcatattcaaaacagtgtagccataagtggagtgaactaacttgggaatagtgcttccaaaatctgcatccttcaccaggatcacggtttctaagttgatacatttatgaacaattcccaatttgtgtatggcctccaatccttcaagcaatctaatcatccaaatacgcgctgttgctaagttaacaaatccaacagattgtatcaaatctcccaatggatagtagttacagtactctgtcaagagtcttattttccaaacaaacgttgcattatttctccccatgcgctccaccgtataaccgaacaatcgattcacattgtcatgcttagctttcaacaccgtctctaactctttctctaaatttgctatttctttttttccattacttgtgttgaaatagctattatccaattcaatttcagatagcaaatagtagaaattttccatcatttcagaagacattaaaaaatctgccaacggagattctggtggtatataaggcttcacaagaaattgtttggaaaaactaaatatatctgatgtcagttttattggcttaggatttacaactgctttaaacttgaacattgagttattaggcaattttgcctttatagtttttgaaaagacaatagcttcacctgatgcaacccattctgaaggtggttgtaaatctaactgggttgttctgttgaatagcaaatcatcatcatcatcttgtcttttctccaactctctttgaacaatttcatctatccttcgctgctcatctgatcttttttttattgtttcctgttgtttttctctttcttccttttctaattgttctttagtttctttgattctttgtaatcgatcatcttccaaggactgtgtatttaccacattttgaaattcgtccagtttttcttgagtaaaagatgtaatttcaaatataatctcttggcctcgggaggtgttgtggattttcttaaattcacttttcagcatttgcaattgactatccattacattttgtacatttttgaattctatttctggagcggtataaggatacattggggtcatcgcaaaatgtaatgttatagaagattcaaccggctctttgtcaacagatcgaagcgtaatttcgaatataatctgtggctgcttatcccagctagactttcttttagttaagtcagtaaagtcatccatataaatggaacgtatcgcttcaagttcgttgcactgtatttcataatattgatctaaagtgagatgactcaatgacatttatacatagtatgtgttaaggggaacggaaaattattgaaaaaaaaaatcaatgcttataaaatcttaaaagacaacgaggctttccaacaatgtaaagattgaaaatttagtgtatttaatgtccttttgtaatgaaaataacttcttgtaagaaagaagatagagataaatgtaaaagtaaatttgcttaaaaagattctaggctgtttatagattgattacaccaggttcttatctcaaaaatcagctactcaactgcttcctaagaaactacctacatcactatagtccaacttaaaacaaataataaacttctaaggctttcgtgtaaagtgatgttgggattgtccgatgaaataacaagcaggcccttgcacgtcaagattaatttgaataaagaagtaacatgtcatctttatgtaatcgctgttattccatacagaacaataaatacgtatatttcgtatgtcatgtggagtatatattcttttttattcttacataccttcatcggacaaaggatgtaattcctcatccgggatcctctgatgggtgactgcttcctccagggtgacatctgaatcgtccatcaatggtttgaacggaagaggatcatcaatgggtgggaagattcttctgtagaaaaagtgtgccattatataacccaacatagaccctaaaattacatcgacgaaatgatgtctgtaatcttgagttctggatagagcaattagtgcagctcctaacagtggtagaaaggccaccatttttctccataaaggcatcaacggtgattcagtcaaaagttgcccacatagccagaagtacaaataacccagtcctgcaaagctttcacttgaatgacctgacggagttgtcctaaacccatccaacagacgttcgtgattcttagtcgtacacacatcttttgcagtaaataaagtgtccaatggcaagccttcaacaggttggcaacgatctagaaaatctggtcttagtcttccaatccaattcttgatgaagtttgtaaagaaactcgtactgaaccaagcgagtgataaaccaaggagagatgtgtacaaaataaaaatcaaatgtcttctatcggccaaaatggaaccaattatcaatatggttaaagatggcacgacaaaactataaacaaacaacatgttgttatttacacgttcagttgtcgcataaggatgcgatatagtgagatcgttaatgtaaaactgacgttcgaacggttgttggtaatacactgggtagttaagaagtatcatgataatgagcaaaaagacatcttctaatctccatttcgcccctatgttgaaaggcgttttaataaacgaaactctgttcattttggtcgtttgctatgatttaattctgattctttgcctttaacaattgataacgtgccctttattgaactgctaactactcgaaaaattggacacaattcagtttatagcaggtgtcctttaagtgatgtttgctgatttccgaactgcgcgtatgttagtggaccctagataacagtttattccctaacgtttctagataatatatgacaaaaatatacaaccgatcgacaaattatttctaaaatacaaaaaagttagtcgtgaggttatccaacgttgggtttctatctatatataaaagctaatcaccaaacaattgagaatcaacgccgataacatgatgtacaattatagcagtatacgccaggcgtgctgcatttattctttaccctgtcatcgttgacgaatacttttttttaaagggatcgcactctaaccacctgaaaggtactatctgaaaaagtgttgactaaaaacagaagcgccttaataatagtgcactactggaaaactatatttaatgtaaaaaagaaactacattgaatgaaatcgaaaagtataatttctctccgtacctgtgactgatacaatgtaacgatgtagactaagaataagattctcacttaaaagctgctatttcaactgattatctgcagagtatgcgatcacaagacagatcacaactgtgtttatcggacataatgctatatttttgctgcgccagaaatcgagtactagtttttaaatatttgttctaaacggtcaaacttttcgtaaaaaatgctataagccgtgttgtccctttatgaagagctgcttcttcacttgtaaatagcgaacaaataaagaaaacaatctgctacctctttgttaaagttgaccgccttgaagagaactgcaagtctctgaaagttttagctgaatattgtcacctcttttaggattaacagtaagcatatttttttctttgagattcggaagtaaaataccctcggcggctaaatttttagagaatgtcaaacttttttagagatagttcaatgggattcaagcctcgaccaaacatcttcgctaagctgagagtcagagatgtagattcagattcttccgctaatactgttgtcgagaattcatccaactgtttagacgtgggttcttctatagagggagatgataccttcaaaaaaccccacaaaacttctaccgaacaagaactgattacaagtatgagccttagtcagagaaaccatggttattctgatgatatggaaataggttcaccaaaaaaaacaacatcaacagaccaatacaacagaattttaaaaaatgatgttgccgcaattgaaaatgatactgatgaagattttgaaattacagaagtaagagaagtgagtgaaggagtagcaaaagaaacgaaagaaagtcatggggatcctaacgattctgagacaactctcaaggatagtaaaatgcatgaatatactatgacaaatggaaaggctcctttgcacacgtccatcaataattctagtacatcttcaaatgatgtcctgttagaagccttcacaaacactcaaagaatatgttcaaatttaaagcaagagctacaaaagcagcaacaggataatgcaaagttgaaagttcgactacagtcgtatgcttccaattctgataagatcaatgaaaaagtcggaaaatataaatcttgtttagaaactcttcaagaaaggattgcaacgttgacgagccataagaataatcaagaaactaaattgaaagatttaagacaaaaccaccaactatatcagagaaggataagcggatttaagacaagtattgaaaacttgaacaaaacaataaatgatttagggaagaacaaaaaggaggcggatgcagaattaatgaaaaaaggtaaagagattgaatacctgaaaagagaactagatgattgttcaggtcagttgagcgaagaaaaaatcaaaaacagttccttaatacaggaaatgggaaaaaatagagaagaaatgattaaatcaattgagaatttcttttcagaagataaagcacaccatttactgcaatttaacaaattcgaagaaagagttcatgatttgtttgaaaaaaaattacaaaagcacttcgatgtggcaaaagatacccttaacgtaggcttgaggaacaccactgtagagttgagtagtaatacagagaccatgctaaagcagcaatatgaagatatcaaagaaaatcttgaacaaaaaatgtcatccagtaaggatgaaatggcaaaaacaataaatgagctgagtgtaacgcaaaaaggacttataatgggagtacaagaagaactattaacgtcatcagggaatattcaaactgctttggtaagtgaaatgaataacacaaggcaagagcttcttgatgatgcgtctcaaacagccaaaaattacgcgagtttggaaaacttggtgaaggcatataaggcagaaatagttcagtcgaatgagtatgaagaaaggataaaacatttggagagtgaaaggtcaactttgtcttcacaaaaaaatcagattattagctctcttggtactaaagaagcacaatatgaagatttggtcaaaaagttggaggcgaagaatatcgaaatttcacaaatttctggcaaagaacaaagtttaactgaaaaaaatgaaaacctttctaatgaactgaaaaaagtccaggatcaactagaaaaactcaacaatttgaacatcacaacaaaatcaaattacgaaaataaaatatcttctcagaatgaaattgtgaaggctttagtttccgaaaacgacactctgaagcaaagaattcaacagctagtagaaatcaaagaaaatgaacagaaggatcatacaaccaaactggaggctttccaaaagaacaatgagcagctacaaaagctaaacgtcgaagtagtacaactgaaggctcatgaattggagcttgaagagcagaataggcacttaaaaaattgtttagaaaaaaaggaaactggtgttgaagaatcactaagcgatgtaaaaaccctaaaacagcaagtgatagttctgaaatcggagaagcaagatataacagctgaaaagttagaacttcaagataacctcgaaagtttggaagaagtcaccaaaaatttacagcaaaaggtgcaatcgcaaaagagggaattagaacagaagattaaagagctagaagagataaaaaaccataaacggaacgagcctagtaaaaaaggtacacaaaattttactaaaccatcagattcacccaaaaaaaatgctacgacgtccaacttatttcctaataactctgctgccattcactctcctatgaaaaagtgtcctaaggtggatcatataagtaagtcaagaattaattcatccaaagaaacatccaaatttaacgatgagttcgatctttcttcatcatcaaatgacgacctagagttaaccaacccttccccaatccaaattaaaccagtgagaggaaaaatcaagaagggttcaaattgcatgaaacctccaatttcttcaagaaaaaaattactactagtagaagacgaagaccagtcattaaaaataagcaagaaaaggagaaggaaatagaggataatggaaaatttgaaatcgttttgtgcgaatacatttcattttgttccctgcgtaagaagtatgcatagtaaaattagcgtagatatagttttttgaggtatatacttattcatagcttataaatatttacagtgttgtaactctagtaaaaacaaaagaggtcatctagattgcattctccttattttatcactgatatcgtcttcttcaagaaagtgcaggatcttggtgcacgacttaggatcaccaactttctcaatatgaagtactggtatgtcgaagcaatattccttccaccattttgcgtttcttcggtcagttatgttgactatctctagtgaaactgctttattatgaaattcctttctttcaaatacatcatctatcacttcctttgcttgatcgcataacccacaattaggctttgagaagaaagttaatttcactccagcatcatgtaacaataccctcgaagtatgtatagaacagcggaacgctctcaacatggtgatatgttccttaagttttatgtcttactgaataattacgaatttctgttatgaattaaacgaaactttacaatgcatcaactccgaactctctacggaaaggtaacaacttgcgcacatcatagacccataaagcgaaaaaaagggaagtcaatcacagttatattgacattccaaagccagtaactaaaaaactacaaaaatggattctcacagtcatattaagtgacctcttattatttcccttaaaacggtaattcttaataaagaacgtcagtgttccgagtgataacgccgtgaagcaccctgcttcattacatatgaaatcgtggggagaaaaaatcgtgaaaacaatatagagaataagtgaagttgaagctccacaagcccttgtaaagtaaacttagattgaagcgatggtattaacgaggcaagtactagaggaagtggagaacacatttattgaattacttaggagtaaaataggacctctcgtaaaatcgcacgcaggaacaaacttttgttcatatgatgataaagcaaatggcgtagatttggtaactgctttagacaaacaaattgaatctataatcaaggaaaatttaacggccaagtatcccagtttcaaatttatcggagaagaaacttatgtaaaaggtgtcacgaaaataactaacggccctacatttattgttgatcccatcgatggtactactaattttattcacggttacccctatagttgtacatctctaggtttagctgaaatggggaagccggttgttggtgtggttttcaatcctcacttaaaccaactattccatgcttccaaaggcaatggagctttcttaaatgatcaggagataaaggtttcaaaaaggccattgattttgcaaaaatccttaattgctttagaaggaggttcggaaagaactgaaggttcccaaggaaactttgataagaaaatgaatacttataaaaacttactaagtgagtccggcgcctttgttcacgggttcagaagtgcaggaagtgctgccatgaacatatgctacgtagcgagcggcatgcttgatgcttattgggaaggtggctgctgggcttgggatgtttgtgccggttggtgtattcttgaggaagcaggaggaataatggttggcggaaattgtggagaatggaacattccattagacagaagatgttacttggctattagaggtggatgtgagtcgatggagcagaagcgatttgcagaatcgttttggcctcacgttgcgggtgagttagaatactaaatgcccccctcaggtgtcgttaaataagctacatctaagaaaagtttatatagtacttcacgcaattcctactagtatttttttccagtacaggacgatatcttgaagcagcaacttgatttcacaggtcacttagtgtgggcttctgactcaagaatagcaagtattacatgcatgcggccctctcctttaacagcgcgatatacgtgaagaaaaatttcaatgaagagtaatgcgcttattatcaacttcgattgaaggggtcctatatcagtatgctacaagggaaggttgttcgataaacataagcttctcattagcatgagttctatagataatgacagcgatgtggatttaacagaagatttagccgtggccaagatcgttaaagagaatcctgtagctagaaaaatggttaggtatattttatcgagaggagaatctcaaaattcgatcataacaagaaacaagttacaatctgttatacatgaagctgctcgcgaggaaaacatagcaaaaccgtcttttagtaaaatgtttatggacataaatgctatactgtataacgtatatgggtttgaattacaaggattgccgtcaaaaaataatatgaacgctggcggtaatggaagcaatagcaatacaaataaatcaatgcctgagccactgggacatagagcccagaaatttatcttgctaaacaatgtcccgcactcaaaaaattttgacgatttcaagattttacaaagcgctcacacttatgaagagctaatagttaccggagagtatattggtgacgatatagcttcaggaacttccaataccttagaaagcaagttgagtacagatcgagatcttgtttacaagggtgttttgagcgtcattttatgcattgttttcttctctaagaataacatattacatcaggaattgatcaaatttctagagacatttggcattccaagcgatggttcaaagattgctatactgaacattactattgaagatttgataaaaagtttagaaaagcgcgaatatatagtcagattggaggagaaatccgataccgacggggaagtgatatcatacaggataggtagaagaactcaggctgagcttggactagagtctcttgaaaaattggtgcaagaaatcatgggccttgaaaaggagcagactaaaagtttgcacgatgatataataaaaagcattggcgattcatattctatatagcattgcataggtgtccatgtagtttaggtgcgcatcttttttgtcgaggaaatagtgaagatgaatacgaaataaactatgggcaaatagttacgaaaaaagactggacttaaacgggttactatatatttgtataagttatctccttgttttctttttactcaaccatcatattaatttgcaagcttacttaacaagtcttgtatactagaagaaacccctccggaattctcaacaccttcgtcggtttgggcgccgacgtggccttctatatctaactcataatgtccatcctcactgttgaaagtaccatcttcactcgtcttcgaatcaagatgaacctttttttccggtatgtcattagcgtcatcatgacctatcatatcatgtgttcgtttcataccaaattgattgtcactaggattatgagtagagtttttatgttcgctatctgtcttttctacaacttcattcttcttatctgtggtgctaatattagtaacgccataattgctgtcattggatctatcatcgtaatttttgtcatcatcatcatcatcatcatcatcatcattatcaccatcatcgtcatcgtcatctccatcccccacttcatacgtaggaataatattgtcttcatcaacgtttttatttaatctggatgggtctttagcagataaaacgaattctatttcacttaacatattctgttcctcatctagatgccttttttcatcgtccagtgtgctttgcagtttatggataccgctttctctttttagaattgattcatttattatatctttagccatgttcccaatcttacttattgttttaaaattttcctcgtaaactgagctggatggatccaattcatctgatgatttgtcaaatctcattttcatcgcgcaaacattatggtgcattttcactaatttttcatagtccttagcaaaatctttcaatttctggggtaacaccaacgcttccactggtgagctctcggttttaagacttctttctatgtcattgactacctgcttggaaaatatatttctttcttttagtatattcacaactcttgacaacttcttttttaggtccctcggaaactcttgattaattcttcccaatacttctgctgccacctttccaaaggaatcttgaaattgaataattttttgacctttagcctgttgaacaacatgattcattaagtaaagacccaataacttccttcttgtgtttacactaggccttaacatgtattctttccacatttctgccactttgggagcatctctatactgtagaagcaaccactttgaggcactggaaatagattcttgggaatcttccaacgtatttaatttggttgtgaattgctcagaagagaaaggcataccgtctattttaatcttggattattgctttcttcaaattttctacctcttcgttaaaaccttcttcgcttgtacttatattattatgttggcttttcaagtttatatatttttaaaggaaaaaaataactttttcatttttcgttataaaacagaaccgttatacatattgagatggttaaggtcgtagaaaagaaatgttcatttgagaaggaaaaatggaggaaggacctatcaaaaagaaactgaagtcagcaggtcaagggagtggaaagaccgatgcctttagaaattttgaacaattttttttccgccttaatactctttacacctttttgatttgcagaaagcatgttgtgcctacatttaaaacactttgtggacctatagaaactgctttgaaaagaactgtgacgaaagaagacctagccatggttatggcgctaatgccaagagaatgtgttttcaagtatattgatgagaaccaaatttatactgaaactaagatttttgacttcaataatggcggctttcagcagaaggaaaatgacatatttgaactgaaggacgttgatgaccaaaatcagactcaaaaatctactcagttacttatatttgaatttatagacggtacaatgcaacgctcatggtctgcaagtgatagattttctcaaataaagataccaacatatactacggaggaaatgaaaaagatgatttctaaaagggaagctctctttaaatccagactacgggaatttatcctggaaaaggaaaaggctaaccttgacccattttctgagttaacaaatctagcgcagaaatatattccaagggagagagattatgaggatcctattgaggcaatgatgaaggcgaagcaagaaagtaatgagatgagcattcccaattattccaataattcagtgataacaacaattcctcaaatgattgagaaattaaaaagtactgaattctacgcttctcagataaagcattgttttacaataccatcaagaacagcgaagtataaaggtctctgttttgagcttgcaccggaagtatatcagggtatggaacacgaaaatttctacagccatcaagcagatgcgataaacagtcttcatcaaggcgaaaacgtcattattacaacatcgacctcttcaggtaaatcccttatttaccaactagcagctatcgatcttcttttaaaggatcctgaatcaacgtttatgtatatatttccaacaaaggccctggcacaagatcaaaaaagagcattcaaggtaatactttcaaagatccccgagctaaagaatgccgtggttgatacgtatgacggcgatacggagccagaggaaagagcttatattcgtaaaaatgctagagttatttttaccaatcctgacatgatacataccagcattttacctaatcatgcaaattggagacattttttgtaccatctaaagttagtggtggtcgatgaattgcatatatataagggtttatttggatcgcacgtggcattagtgatgagacgtttactaagactgtgccactgtttttacgaaaatagtggtttacaatttatttcatgttctgcaactttaaagtctccagtacaacatatgaaggacatgtttggaattaatgaggttacgctaatacacgaggatggctcacctacaggtgctaagcatctagtggtgtggaatcctccaattttacctcaacacgaacgtaaacgagaaaatttcattagagagagtgcaaagatattggtacaattgatattgaacaacgtaagaaccatagcattttgctacgttcgtcgtgtttgtgaattgttgatgaaagaagttcgcaatatttttattgaaactgggcgtgaggatctggttacagaagtcatgtcttacaggggtggttattctgcttccgacagacgtaaaatagaacgtgagatgtttcacggaaatttaaaggctgtcatatctaccaatgctctagaacttggtattgatatcggtggactagacgcagtcttgatgtgcggtttcccactatcaatggcgaattttcatcaacaaagtggtagagctggaagaagaaataatgattctttaaccctcgtggttgcaagtgactcgcctgttgatcaacattatgttgctcatccagaatccttgctggaggttaataatttcgaatcttatcaagatttggttcttgatttcaataacattttgatactggaaggacacatacaatgcgctgctttcgaactgccaataaattttgaacgtgacaagcaatactttactgaatctcatcttcgcaaaatctgtgttgaacgcttacatcacaatcaagatgggtaccacgccagtaatagatttttaccatggccgtccaagtgtgtatctttgagaggcggagaagaagatcaatttgccgtagtggatataacaaatggaagaaatataataattgaggaaatagaagcatccaggactagttttactttatatgatggcggtatattcattcaccaaggctatccctaccttgtgaaggagtttaatcctgatgaaagatatgctaaagtgcaaagagtagatgttgactgggtaaccaaccaaagagactttacagatgtagatccacaggaaattgaacttatacgctctttaaggaatagtgatgttcctgtttactttggtaagatcaagactacaattattgtatttggcttttttaaagtagacaagtacaagaggatcatcgatgccatcgaaacccataaccctcctgtaataatcaattctaaaggattatggatagatatgccaaaatatgccttagaaatttgccaaaagaagcaattaaatgtagcaggagctattcacggggcgcaacatgcaattatgggtatgttaccgcgatttatagtggcgggtgtggatgaaatacaaactgaatgcaaagctccggaaaaggaatttgcagaacgtcaaactaaacgaaagcgaccagctagattaatattctatgattccaagggcggtaagtacgggtctggcttgtgtgttaaagcgtttgagcatattgatgatattatagagtctagtttaagaagaatagaagaatgcccatgcagcgatggatgtcctgactgtgtagcggcttctttttgtaaggaaaacagcctggtcctgtcgaaacctggcgcccaagtcgttttgcattgtattctaggtcactcggaagatagttttatagatcttatcaaagatggtccagagccaaatatgccagagataaaagtagagactgttattcctgtgtcagagcatgtcaacttttcagatgattttaagattattgacgttagaagagctacgaaagacgatactcatacaaatgaaatcattaaaaaagagatatgagcacgctatttgtagtttgtaaaccgaatataaatactctattctactacttgtagattcacttggtggaaagaagttacatcaacattctgtcaccttgttgatgcacagaaaaaaagacactttattattgttgaataacattgtctgtggtatatatatatatactatgatattacagtttttaagacattaatgtattaacagcccattttacgcttaatgtcctcaaatcggtataggtttgtcccacgccaacgaataagataggaatccccgtagcataaaccatatttaccatagtacccagcatttcaccaactgtgtcacacttggagataataaagaagtcaagatttcttccctttccgaaggcatcattaaaatttttggcttgctggacagaatcagtacctactaaagcctctccaaccataatgattttatctggcttggcttggtcagcgaaagacttcaatggcgacattaaagtaggatcattatgccttctcccggcagtatccattaacactatatcgaagttttgatcacgagaatatttgatggcttgctttgcaattttggttaccaagtcagatccaccataaccagcttcaaatagttcaacgtagtcattaccagttttaccccttttgttcttggagccacgaacgtgtgaatcatccattagctgtgccaaattttcaacatggacccttagttgctcaactgcaccagacctaaacgtatcacaagcaacaattaagaccttgaaattattttgcagtaaccaaaacgctagctttgaaagatttgttgacttaccaacaccattaacaccaactatagagaacacatagggatcacatttaccttcttcatcctttttgcttcttttgctctgaatttcacggaggagatcaacggatacaccaggcgttaatatttgagttaatgcttttgttaaagattcacgagcagtattctcaacactggtccaatttgcagtttttgagcctacaagatcatgtgagacttgctgtgttaaatagtctgctgcctctggtgctacatttttggttatcaattgttgtgttaacttctctaatacagatttcaaatcactttcattgatcgttttgttacctagaacgtgtttttgaaggaatccaaaagctgtactgacgtatccagaatttttagcttcgttcccactagttatctcgtctttatgagaagacaaaagatcatcaatttctttgattaagaaatcgcctccttctgttctatccccaaaagaatctttattaatagtggagtctagagctacttggctactattgtggctgttggatgatgagaaatctaatttggctgcatcttcatgattcatttcatcaagcatgccaccatcacggccccactttctcccactaccaacatttcctgtagattgcttcttaccttttgtatccctcaattttttcttggtatttttattatgcgattggggtactgatccatttttggtaaaattatctggattgatatggtcttgttttattgactcttcatattttatcctaaaatattgctcaaatttcttcaggtcgtcttcaattccctgaagaatatcgacgtagttatgcttgttcttttcgttttggccctgacgattttttagaatggattcacttaaatgcaatgagttccagagttttaacaccagtgcaagtgtttgttgagtttcttgattaagctctaaagtctgctcggcaaaagtcactacgaaatacaattctggttgcttattcaaataaaatagtgcattaaatgaaggagaatttttgtgttcgctgttgattgttaaaagattgaaatcaaatccgtctgtatttgcgtttgcaacactttcttttctagttactggggaagtaatcagctgggatataaagctgttaatttgtatttcagaaaacttttttcctaaacagttatattggtaaagtacttgaccttgaggggtaaagactgctaattggtcgaacataatcaatgcacttattgaaccgtgaatctcctattgaaaaaaactacttgatgaagtagctgaatattattcaaactgtgagaataccacaaatctttggctacagattaaacgctgacgaaaaattggtttatttatttctatctacttattgtacgacctcaaatgtttacgcagtagtttctgaagtacgagcaaaattgctcgacgatgatttcgttattgtttccggaaaaattacccagcgcataaaaagtaagctttcagtacttctctttgatgatatttgtacagcaaaagggtatttagtaacggaataaatttaatatataagagtataaataacaaaagacaatataaattgaaaagttgtaaatattgaaaagaaggctgcattattgttttatgtatttttgggaaaaaatatatgacttaacgaggtcgaataaaaaaatttggatgatgccttaccggaacgtggattaaaaggagaagtacaaaattcatgcagttgttaatgttcgcaggaaataaaaacaaagggaagggatactgaggggtgaagcacaatccaaagaacgaaagtgaaaaacaagaaaaacagcaatgacgatattggtagaagagattataccctcttcatgaatggatttaatgcacggacggttaaacatggcaaagccatccccacctcagctctcaatagaataggaatcttttgcaattcatgtatttcttgtatatagttatcattttcaattctggtttcagtagtagaaatgaatttttctaaagcattttgcttgttgtcgcttgcagatggtagccttaaatttggtactgttagatgcaaatcgctgagttccttactcaatggatcgctgatcaatggttcagattccgcttctttatctagttcaatattcgcaatctcagcggctgtggatctgaatttgttcttaatggaatttctataggattttggatttttttcatctgctggtataaaagttgcactatctacgccgggctgccaatgcaattccaagacacgattggtaccatcaaactcagctttgatcaaaggtagttgatctccatgaactctcttttcaataccaaattctggaataaatacatcaaaggaggactcgtaaacttgtaagacagtagccattgttaataattgtcctgtagtatttcccatgtcgttgattgttttacacaacaatagatgaattgcttgttcctgtgcttgataagcacagtcctttttaaaattacaatattcggaggtaatcttcaaagcttccatatcttcggtgtatggagtatcgtggataacggcctttaattgcctatgaacgacatgatcagcgtatcttctcattggcgctgtgaaatgtgtgtagataggtaggttcaaggcataatgcccatattggtccgggtctactttgccagcaataaagtatctagctcttggcatggttttaaacagtaaaatttcaattccgactctaacatcgtcatctttaatttttagcacccctttgattaattcatccgccgtattggtatcaaaattgtaaccaaaattttgaattttctttctaaatgacgccatcttggttgcaatgggttgcatctgccttctcaaaagagctagatcaccaagtttggtgtaaattttctctgcaacagtggagttgacctttcttttaatctcattaattacaacaaagcctaaagttctatccaggatgttcaagtcaaccttaactttttcgtcatccaagctttccaataaggacagggtgggaagtaatgtagcttctggatcatttattcttctagcataaaatgatctagcaatttcctgtacagtagagaggtagctagtgggacttccagtagataatttttcgtctaattgttctaaagacaagatgtttgagggggaaattgtagattcgcctacccaagtagatttaatccttaaagtagatgagtctagagtgtaaacaaccgacagcgtggctgattccttgccaggggccaacgacagttcgtcgttgaacgattgtggtaataaattgacaagtttttgtggcatgaacaccgcagaggacctctttctcgcacgcctatcaacagaggagccttcttcaatatggctggtcacatcaacaacatgacaacccagctctagggtaccatttccgttattcctgacatgtaaggcaaattcagacacccatccaagctcggaaattgcaaagatattgtactcattagtgtccgtaaaattcctcctatattctagactttcagccgttaatggtagcggctgaaaacttggtttttctttttgcggatttttttgatccaaatattcattcgaaagaaaattgttatcccttaaaatggaatcaatttcagtatcaggatcgtgaatatctccaagttcggaaactaaaataccaaatggatgcaaagatgtgattggccaacgtttaatagaggcaacgaataacttttcggagtatttatcagcgttttcaacaaagtcctttggagctaattctgtaggaattgcaattaatggcaccttcttatcagtaggcttgaaccaagcaatttttgggctttgtggtggtttgttattgtcgctattagcttgttgggatggtctcaacaaacctaatgtaccgctaaataactgaccagggatacggtccaaaacagcaacgacatggcctgcgtaaagtggcttatatttatcgttgatttcttcttcttcaactaataacaatgactgaccttcaacttcaacatcgtcatttttcttttgagttggacgttgtttcaatgaacttcttctccttactcctgatttggtaggagatgataaggaatcactatcattattgatagtagatgacctctttcttctgacggataaatcatccttgcttagcgaatcagacgaggagggagaagatagaaaattgttgcttgttgcagcagtaacagatgcatcgttgtggtaatcgtcactactgttcaaaggaattagatcgtgttgcatagaggcatcctttctcctcttcttttcttccttttctttcttggactcccaaacatcgtccacaactaatagttctaccgcgactaaatcaccttcaagtgctctattacgatctttggagccgcaaatgtaaatatccgcatcaagagcgccatctgtagagacccaggcatccgatctattctttttattaactcttaatataccagctactagtctcccttcttggattagctctggaatgttggcttggggaaggtagggtgcaaatagggacttacgtccacctccgttattattaccttgtgaactgaaactatgaactgatgaattagaggcacgatgtttgtgtccctgctgaaatatcgcaggaggttctaaggtattgaaggaattgtaatcccttgaattagatcctctgtggcggaatggagaaagctgctgttgaggttgctgtgattggtttctccagttggaattaatgcctggagaatattcattgtttcttgtctttgaacggcggtgcgttgaagaggttgctatgaattcatcgtcattatccccgtgagagtttggaggaaatttgaaagagggaggtgataggtttgaagttgcgcgacgatggccctgatgagcatttggtggtggtggaaatttaaaatcagattgttctgtagtagaatttgagccactatcagcttgaacagaatctatcttcacagttacgcctgcttcacccccagatattcttttagcttgttcttccgcagcagcctttttcgcttcatttagacctaaagaatgtcttctggaatggccatatatgctggattgtgaactcgtctttctgtgtgagttagacccaggattattgctattgttattgttatcatatgaattatgataatatccggagttgttcctggagtgagttctacttctgctgccacctgcactcataccaggtgaattaccgtttgagttgtaatgagggtgaggcggttgaggcgtgaaatgattgttagagccagaatttcctgacaggtattgtcctgtctgttgtgccaattgctgttgctgagccatcaactgttgctgctgtgcttgaacttgctccaactgcttctgcaaagtgaattgttcaatcatcaaatttgtcaactcactttgggaacgtctgtgtgcaacatgaatctgctttggggcgtttttaccacctcctgtggtttgcacaaacatgttatttggctcttgggatctattgttgttaacgttgctatttttagacatagtgtataaagatggaataattgggccaaatctttgcgctgaaaggtttttggtgttctgttttgcgatattaaagtgacaaagaaaaagatggaacttggcaaatactatacgtttatgaacccttgtcttattcttcgtgcaggcaacttagatttccctttgaaaaaaagttgtttcttttagaatagtggctatgaaaaaagtgcgcctaatgcggaaaaacgaggcaccagctgttctaaaataagaccaaaatgtttagggtaccagaaaaatggtatggcgaaaataagcctggcaagaagactatgcagataactttgactattccggtttttaggttaccaaagacagaagaaaggatcggtcccaaaaaaaggaaatagcttataagggaagttgcagaaaatgcgcttgagtaacaaaaaatgttagaacgtagcaaatattctaaaaggaatgacagaaaaacttcttacctttctaaaatataatctctcctatttctcagctaggctcaaaattataatttagaaattattgtttgcacggcaaaacttcgttcctttgctgttagaaaatcagtcggtgttggactcttcgtcttttaaattcttgacaagagaagagtttttaaatgaaaagaactaacgagaaaaaaccaggggaaggagggaaagagcgaaaatactcgtgatctaaactcttttaggttagttttcgttggaggcagtggtcttaagacgatggtgaaagaaaggacttatttgtagaaggattgtttatttaatccttgaactaaacaaatgacaaactcaggtctctagcgttcctgttcgtggcctttaataacttgatggcaatggtagaaagacacacctgcgttatataagtttagttttcccttcttttcctttctcatcccctcgtgaagcgactcggcccctttggtcagaaaattcaaggtgatacaagtcgtcgtccgtgacataggatcaggaatcacaatcatcacattgcactctcgttctttaaattatgtatgagatttgattctatatagctacttggtggcggtatcctctcctggacccaacttgtataatgcgtctaggaatcccacaatcaatttgtctgcaacgccagcagttttaacgctcccggcgacaccatatagagcgctagttccgtctggggatggtttagaatttgattcgctcttcaactcttgcacggtagtacgtaaaatgtcgcagatctcatccacaacatgagcgctcaatctcgtgaaggccatgtgtagtgcaaccggcttttgtagggcattgaaatgccagcctttcttggacaacctgtcagatagttcgtgtatgttcaaggtctttgaagaaaatgaaatgactgaatatctagggttgcccattatattcaggtctggaatgttttcctggatgtattttttaaacttcattgctgcaccgactatttcttggcacgactcaatgtacccattttcacccatgttgaccatagtggcccaacaacctacgacaatagcaccaggcctggaccctgctaatgtaggagagccatataacccgccagtccaagcaggatttacgtaatactgatgcattcgtaagtcgctgtttctatacattataactgacgagccttttggtgcaaatccatatttatgagtgtcacatgatattgaggtgactcccgggactctaaagtcaagtaatggcagatttttgtaaccagccttttccataaatgaaacaataaaggaacctagacaactgtcgacgtgtaaaggaagtttatatttttgtgctattttacccaatccttcaatatcatcggcaataccatgaggaaagtttggagcggaaccgaccagtaaaattgtgttcttattgatgaattttttcacttttcccaggtccacttgatatgtcgttggatctagctccacgtggcgtagcttcatgccaaagtaataagcagctttgtcaaacccagcatgtgcagttacgggagcaattatttctggttcggtgattccacgatgatgaagggcatacattttagcgctcagacatgctaaaagcaaggattctgtaccacctgaagttgtggtaccacaacctgtatcagaaggggcattaaacattcttaaaaccatagaaaccacttcggattccattttacgtacggcaggaaagacatcgggatgtaattgattggcaacgcaatatttttcgtatgcgattgtttgtaagtggatcaaatcatcaccaccgtggtaaacggcaccagagacctttccttccttccattgggtatgtggtatcaagtcgttcaatttatttagctcttcaataacatcatcctgaggtatcccattggatggcaactgtgggaaattcattaactgagagtccgatctaattagttcgtcttcgatcgattgtttgacctttgtgacttccttttctacggtacccctcaaaaatggtgagtccaataaccaacgaaacaatcttctggaactatgctcgtatgttctcactgctaacctcaccggcccataaactttcaacagataaaaaaaattacttattagcttgtaacaaaagatcacaaacaaataatccttcaacatgttgtaccatggggtatttctgaggtaaccatgtatggctatttttaattcgttgatggttagaatcataaactgggcaaagtcgccttcttcccttagtaaatgaattggcatgccataccaaccattaattgatactgttttatttgatactccactcattgtattagatggaaaaatccctttacagaagctagcctacttgctcggtaaagaggatctggaatagttataacggttggagaggcaaattgagggttttatttatatgtgtactgaaaatataccaattttttcaatcaaaaaaccccgatgcggccggccggtatatatggtaactaacatgaaataatgcaccagagtagttgatgaaatgtttctgaagaataaggcgataaacgataggcaactgtgtagatttaaatatttggccaatctctatgtactttctctttttttccagtgtcaaatacttgtagaaacagtctaattcattaagaaagtatataaaatctctctatattatacaggctacttcttttaggaaacgtcacattcatgtgtaattaggggtattggatcttgttgatctaaaccgtgtaccatttgcggcagctttttccacctggacgttgtttttgttttttaagtcgtactgtcggttcattaaggttatgtaattctttaagaatttgtttcttgctttaagcgactgaaaatcattctgtaaacgttccagctccttcttcaagctttctgtggaaaatttagtcagtggaccattaacttcgttttctaaagacttcattgattcttgcaaaattttcaatgtttgcgcggactctgcggcttttgaagattctatttgatatttggaacgtagttcatcattgagctttgatttttccgcatttgcttgttggagttcctttaacttattaaaaagagtcgcatttttgtctatgtattccttcaacttgtctgctaaggcagatccctcttccagatgattttctgatgaaatagtattcgagggcaatttgttgaaattctctagttcctgcctatttttcagtaagtgatttattttattttgtagcttggtagattctgtcatcgcatgcttcaaccttttttcagagtcattaatggatttttccacttcttgttttttcttgaatgtaagaccaacagaattctttatttcgtccaactggttctgccgttgagtttcgtttaatcgtttctcgtacagtggaacagtgcctttggcatactcgtcctgtatatctcgcaatcttatgacggctctatgcattaactctgtttggtaggttttgatatccaatggtccgtcccaaaggggcaattctgtagacgaatattgcaattttgttaattgaggctgccaaaacccagaatcgctcgaatctttggaggcctcatctaacgttatcaaatccaaaaccggtaaaatgttattgcaatctttcccctctaaacaacactttaccaatttaatataatcaatctcacagttgttcaccggagcattccttgcttgcaaaaaatatagtaaggaggatttgatctcttcatattcttggctatcatcgacatgaccgttattgctcaaatgcgacgatttaacacttgaattcttgatttcagaatctaacaagtaatgatctggagaattttgtactaatagctttattatcggaatatccttattggcattattcctcagtacctgcaaagcgggcaattcaacttccaacattggatcaaaactaattatcatatctatatcatagttagccaataggtattgatcgtgtttgagatgtttggtagtggctaaaaacagccagtcatccgtatttatttttctttttttcaggtttcttttcactgagtaatcatagtcgtccttagaataacctgtataagaggtcgaattggaattagagcttgtgctgcttacagaatttggtgttccatctttatttattgtggaatcgaccgtaggtagattagggaatttgtgtttctcattataaagagatgtaccggaaagtctcttggttctgaatttcttgcctaatattaaaccttctagcaaatctaattcctttatgctgtgtgcgatgatggcacattttataacttcgtttggtgagccctctctgtctctaaagcatatcgaattaatgagctggttgagaacttgaaacttgtggctcccagcaatagagctttccgtgggctccattctcaaaagctgtcgaggcatataatggtccactagaagggaaggatgattggctattgctcttatgtttgaatcaaagatataggttaattgcctttgtgatagcgttggatacggatgtgtttcagggccagcaggtaagccggaaggcttgttcactgcatctgcctgtggttctcctattatgcttgctttgaatgacttggcgtgcagggatatcaaaatttctgataaatccttttgaaattgggttagcgttacaggtaagtaatagacttttagtttcttagaatttttcctactcatgtcgatagtattgtatctattttctttatttttcacacactaatgaagccaaatacttttactactacttaaacgccttcaatcgttctcaattctgtctttttaaaaaaaaaaattttttgttacctctcctttctcgatgttctactagttgtggttactcttctgtgccgcaattatgttattttagtaggactgtattttttttttttcttttgttgtcgcttttcttatatatctatataactatttatttgggctgtagagaactttctcaggaaatataaactaggagacattcgtgtaagcaatgaaccatatacgccacggttaaatttcagacgtgcataaagttgatgattcctgtcaagttaacgactcattttgtacggtagacgggaaaaatacatttcctacaatattctcttttccgatattcagatactaaaggaaaaagtgaaagtaaggctatatgatgaaatgtagaggaaacggaaagaggagatcctgtgaggaataaatagagaaacagcgacggaaaaatcgatatttcagggcaaaagcatgaaggtaaaccattcaatttcaagattccgccccgcttcatggttcgaaaagacaaagataatcccaccccaggtatacatctttaggaacctagagtatggacaagtactatattctcaatttcccaacttttcgcaaacacaggtggataagctgtttgtgagaccaaactggagcaacagaaagccatcattgagaagggacatctggaaatgtatgtgtgtagtgaacttgcaaaactataagcagagtgtccatctataccagaacctctgccggttgagatacctccgtgatgtggcacagcgtaaggagagtgacaagctaagaaaaaaggactctaacgggcacgtctggtatagcggacagtatagacctacatattgtcaagaggcagtggcagacttgcgggagtccttgttgaaggtgtttgagaatgccacaccagcagaaaagcagacagtacccgccaaaaaaccgtccatatactgggaggacccatggaggatgggtgacaaggacaaacattggaattacgatgtgttcaatgctctggggctggaacacaagcttattcagcgtgtggggaacattgcgagggaagaaagcgttattctgaaggaactagctaagctcgaatcacatcctacagagcagacggaagtgtcttcccagtagaacgcttcgtcattagatatacaaatgcaggtagaaaaaaaaacatatataagctcatgtaaatagtgcaatgcaaacctttctgccaaatcccgttccacggaaaaacacgtgctgtgcgggtatccgcaaaaagaagataggtcaaaacaggaatacacagggctagtctttattactgccgctgctgctgctgccgctgctactgctgctgttgtgtgacttgaaacgcgttttatcctcctcaccttatcgtcatttctctatctttttcacttgcacagcttaataagcttttcgacctcctgtttcctattgtcttattccctcaccccgcgtccttcttcgggcagtcgcgcttttctccggcttctgcggtttttcttagtctttccgcaccaattttcacagaaaaatttctttttgggttactaaaaatttcttgtttgctattgtcttgatttatttcactctttcttcatcctgctgcgctgttgttgccgcatttttcgtttcgtgttttgggattataaaagaagtaacgatttacatatcttctattcccttgcatttactccgggtcttcgtctttactgtttggtctgggtatttctaacattctagtccgaagagggtgtatacgaaaagaaaatatacgatgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgttttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctcttttcaacaatcctgttgagggcttcttgttagatactttgggaaccggtattgccatgacgttaactcatttgactcacagagagcaaatcattctttttacctttgccaccatgaagactgtcgatgaccactgtgggtatgctttgccacttgacccattccaatggcttttccctaataacgctgtctatcacgatatccaccaccagcaatttggtatcaagacgaactttgctcaaccatttttcactttctgggacaatttgttccaaactaactttaaagggtttgaagaatatcaaaagaagcaaagacgtgtcaccatcgacaagtacaaagagtttttgcaagagagagaattggaaaagaaggagaaactcaaaaacttcaaagctatgaatgctgctgaaaatgaagtaaagaaagagaaataacccttttgcatacctcccgttcaattgctgggtaaaggcaatgtctccgacttcccacgtttgtatttattatccatttatatacatcaagacatattattaagtgtataggcgtgactttgactatatatttgatttgtaacgaaagaatacatcaaaattcaactatgaaatggttattattgtgcatgcacatcttgaattatcaaaaaggtcttaaatgttcttcggactttcttgaaatcttcgaaaactgatgagaattcttcattatttttttttttcttcttttattattttttatgtttattccatatatacacttataatttttttttttgcgattaatataagtttgcctggatacacgaacatatatatgattaaaatggttgtctcgaacaaaaaaattcactttttagaggggtttcttatttattcgtatatgtacgtaattttgatgtttaggaaaaattcacggaaaagaatatatatttgaacagaatcaaaaattaggagggaggcaaagaaagtaacatcaaacgagttgagcatatccaactatattattaacgttaaatgctgtcctctaagaccttattcagtttttgaatctttgtagaaatgcttaagtcaacagtcttgtcaccaagttctacaatcaaaccacccttaatctctggcttaaccacgttttccagcttcaaagatttaccttgccccaccaatttggaggcgctcaaagctttttcaatcctcttgaaagatttaggatccaatggttcagcactagtcactgtacctttaagtaacccgttgtgagcatcgtttaaaacgccaaagtcagacgcaattttttcaaaacatcccagtctgttattttcggaaagaaccttcaataggttaacgacataaccatccaaattcttgtgagtctccacgatggcatcaatgacagaatttctgtccttcaatgacaatgcaggattcagtaataagtgacctaattttggattctttttgactgtgctttcaactttttgcaaagattgaaaggcagcatcaatagaggagttctttgcagcggcctgatataaagctgttgcgtaagtgccctcaacaccgaacaatctcaccggtgggggagcagcagctttggaagcagcagctcttaagcttgatgcaaatgacctggtaaagactctattaaacatgattgtccacggtttaaaaataatgcggtaacttgctaatcggttcttactctgcggaaaaatatctcaatgccacagtagcctgcttaaatttccaagttgactgaattttgttttcaatgagataaaaactagaaatactgtacacaaagttaacaattggcgtttgaaattgttcctagataattgaaagttttactatctcgccaaaagatcacttcattatctttaattccttgtttttcccacccgggcccgggtaaatgatatttcaaatatcagcatcttattggccagcaccgtctctcgaaagtgtccactttatgacgacggcataaaatataacgatttattggacgtaagtagttttataagttactaaaccaagattattccggcaaaaaaatgaactttaagagatatctgagcgcttcgtatttcttggtagtcccttataatgtactacatttatgtagaccaggtttgcagccagatcttacgggaaagagattttacggctcccagtccgagcttttccatatactactctaatatacaatgcattcttagatttcttaactgctgcatatgctgtctttggtcctttgcaagcctattactgcggatttaagttttttccactgatcgttacccgaatttatgggttctgaaaaattagaagatggaaaatttttcaatacgcgatgagatgagataattgtatatatgtagtcgcatcttgataggtatgcagcgtaccatacattgagtaacaataagcactgttaccaataaatatagagcaaaaaaagatggaaaaatcactagcggatcaaatttccgatatcgccattaaaccggtcaataaagacttcgatattgaagatgaggaaaatgcatctttatttcaacacaatgaaaaaaatggagaaagtgatttaagcgactatggaaatagcaacacagaagaaaccaagaaggcgcactatttggaggtggaaaagtctaagttaagagcagaaaaaggtttagaactaaacgatccaaaatatacaggtgttaaaggttcaagacaagcattatatgaagaagtttccgagaatgaggacgaagaagaagaagaagaagaggaagaagaaaaagaggaagatgctctttcattcaggacagattctgaagatgaagaagtagagattgatgaagaagaatcagacgcggacggcggtgaaacggaggaggctcaacagaaaaggcatgcactatcgaaactaattcaacaagagactaaacaagctattaacaaactgtctcaatcagttcaaagagatgcttcgaagggttattccattttacaacagacaaaattatttgacaacatcattgatttgagaataaaactacaaaaagctgtaattgcagcaaataagctcccattaactacagagtcctgggaagaggctaaaatggatgattcagaggaaacaaagcgtttgctgaaggaaaacgaaaaactgttcaataatttattcaatcggttgataaatttcagaataaaattccaacttggcgatcatatcactcaaaatgaagaggtggcgaagcataaattgtccaaaaaaagatctctcaaagagctttaccaagaaactaatagcttagactcagaactaaaagagtacaggactgccgtattaaacaagtggtctaccaaagtttcttctgcatcaggtaacgctgctttatcatctaacaaattcaaagctatcaacttacctgcagatgtacaagtcgaaaaccaattatccgatatgtcccgtttgatgaaaagaacaaagttgaacaggagaaacataacgcctttgtatttccaaaaagactgtgctaatggcaggctaccagaattgatttctcccgttgtcaaagatagtgttgatgacaatgagaattcggatgatgggcttgatatcccgaaaaactatgacccaagaagaaaggataacaatgccattgacattaccgaaaacccatatgtttttgatgacgaagatttttaccgtgttttactaaacgatttaattgacaaaaagatttccaacgctcacaattctgaaagtgcagcaattacaatcacctcaactaatgctcgttcgaacaacaagctaaagaagaatatcgatactaaggcttccaagggtaggaaattgaactactcagttcaagatccaattgcgaattatgaagcccccatcacatccggatacaaatggtcagacgaccaaatcgatgaattctttgcgggattgttaggtcaacgagtgaactttaatgaaaatgaggatgaggaacaacatgccagaatagaaaatgacgaagaattagaggctgttaaaaacgatgatatccaaatctttggttgaatatacatttattttaaatacgcacaactcatttaatttagggcttataagtagatagaaggattttaacggatcacaaaaagtagctgttaacaactaccttttttttgagttaagaacactaatgtggattaggaagaaacagctgctctgcacaattcttcaaaaaaacaaaacatgcttaatgtgtcattatttaacctggaaatataaaggtagtgttttatataagaaatatcattaagggaatcctctataactttttagttcgtttcaacgaggtgggaatgccaaattttctctatgagcgacatattcgctgtcattatagcccaattcctcttcgatttggtcactgtgcaaacctttaattttagttaattcagaactcgtgtaattgcatcttgccttgcctactgtttgcaagggaaaatctggatctaacgtgccatctggtaactttttaccaacttttatgtcaacacattctaactcatggaaagtgccctgaacatcaataacacctgctggcaataatcccgccttatttttccttgttaaggctgcgtacgcaccttggtctataacaacagcgcctttagagacaagaccgtgtaaaatccaaaactctctattctttagatggtgtttattatcattagcaatgaacttcgtatgtagtggaacgttaagagcctttaatttctcaaattctcttttttgcaaatccgttaaatcgccattatatgcttgtttaactttattttcatcgtcaagttctagagtttgcatatactcgacaattctacctatattcgcaggtgtatcgcttttcatgatcaacgtatgaacaccggcattcgttgccaaatctgcagcaaccaatttagtttccataccaccggtcccaacgtcagaacctgaaccaccagcagtattcacaccgggcaaaccctttgagagatctgggacaactaagatcggcatggcatctgggtttgtccttggattatcagtatacaaacagtcaacatctgtcagtaagaaaagataatctgcatggattaaagcagaagtaattgctgataaagtgtcattgtcaccaaatttgatttctctaacagatagtgtgtcgttttcattcacaatgggaataacgcccatgttcaacaattcattaattgtgttttgagcgttcttatattgggtccagtccagaatatcatttctggtcaatagaatttgagcgatacgttgatcaaattgcgaaaacagaagatcccatctcccgatcaatctaccctgcccaatagctgcgatggcctgaacttctgctaaatgttttggtcttttattcatacgcatagtcctcaaaccaacagcaataccaccactggacacgatgataactttgtgtcccattcttctcaatttgactacagtttcgacaataagcgacatgatagctaacttaggttctttggttttttcatctactagcgatgaagagcctaatttgatcactatagtatacgatttactctcattagcatccttcattttcgcgttcttatgactatattacagtagctgataaaatgacctaaactatgcctatctttgaagcaactagacattaatcttgaaagaccgttttgatggatgaataattcatcgagaaagcattagttcgctgatgtaatttttcatttcctgccatcatgcgatgtgtgggtgctatttattttcaattcctttaccaaggtacctgatagtgtcataaataaataaatttagacccaaatgtaaccattgataagtgagagtcttaaatttaacatgttcatactttaactggtgctcaaccgatatattatgattcactgtgccactgaccagccctattagtgacattttgtgcttcctcatcccgtcggctcccaataagacaacgtagtaagtgatcttaatataaggtaagttcgaggtgacatatttcacagagcagcgttaaagcaatcatatgtaaattgaggaagatcaccgtcccttgaacacttcactgattaaaactatcaggtactaacctagattcgctttttactctagctactggccctatgaatgtatatgatgatgtgcttgacgctactgttgtgtctcattcattagcaacacattttactacttcagattatgaggagctcttagtggtgcgaacaaatatcctttctgtctacaggcctactagggatggtaaactgtatttgactgatgagtttaagtttcatggcttgatcaccgatataggcctcattccccaaaaagacagtccgttaagttgcctgcttttatgcacaggcgtcgctaaaatctctattttaaagttcaacacgctaacaaactcaatcgataccctaagcctgcattactacgaaggaaagttcaagggtaaatcgttggtagagctggccaaaatttccaccttgagaatggatcctggaagttcttgtgccttactgttcaataatgacattatcgcttttctacccttccatgtcaataaaaatgacgacgatgaggaggaagaagatgaggacgagaacatagacgatagtgaattaatccatagcatgaatcaaaaatcccaagggacgaatactttcaataagaggaagagaaccaagttaggtgacaagttcacggctccaagcgtggtattggtagcgagtgagttgtacgaaggcgccaaaaatatcatagatattcagttcttgaaaaattttactaaaccaacgatagcgctcttataccaaccaaagcttgtttgggcaggaaacaccaccatttcaaaactccctacacaatacgttatactcacattaaatatccagcctgcagaaagtgccaccaagattgaatcaaccacaatagcatttgtcaaggaactgccttgggatctacacaccattgtacctgtttcgaatggtgctatcattgtgggaaccaatgaactggcatttctagataatactggcgttttacaatcgacagtattattaaactcatttgctgataaagagttacagaaaacaaaaattatcaacaattcttcattggaaattatgttcagggagaaaaacactacgtcaatttggataccttcgtccaagagcaaaaacggaggaagtaataatgacgaaacactactacttatggacttgaaatccaatatatactatatccaaatggaagcagagggcaggttactgattaaattcgatattttcaagctacctatagtcaatgatcttttgaaggagaactccaatccaaaatgtataacacgtttgaatgccaccaattcaaacaaaaatatggacttatttattgggtttggttcaggaaatgctttggttctcagattgaataatttgaaatctaccattgaaacaagagaagcacacaatccatcttcaggtacaaatagtttgatggatatcaatgacgacgatgatgaggaaatggacgatttatacgccgatgaagctcctgaaaatggactaacaactaatgattccaaaggcactgtggaaactgttcaacctttcgatatcgaactgttatcatctctaaggaatgttggtcccatcacatcgttaactgtaggtaaggtatcttccattgatgatgtggtaaaaggactaccaaatccaaacaaaaacgagtattcgctagttgccacatcgggaaatggttcaggttctcatttgaccgtcatacagactagtgttcaaccggaaattgaattagcattgaaatttatcagtataacacaaatctggaatctgaagatcaaaggaagagataggtacttaataactactgattccacaaaatcccggagtgacatatatgaaagtgacaataacttcaaacttcataagggcggccgtttaagaagagatgctactacagtttacatttcaatgtttggtgaagaaaaaagaataatacaagtcaccaccaatcacttatatttatatgatacacattttagacgtctcaccacaattaaatttgactacgaagttattcatgtttccgtcatggatccgtatatactagttaccgtatcaaggggtgatattaagatatttgaattggaggaaaagaataaaagaaaattgttaaaagttgatttgccagaaattttgaatgaaatggttattacatctggtttgattttgaaaagcaatatgtgtaatgaatttttgattgggttgagtaagtctcaagaagaacagttattgtttacatttgttactgcagataaccaaattatcttttttactaaagaccataatgacagaatctttcaactaaatggtgttgaccaattaaatgaatctttatacattagcacttatcaactgggcgatgagatcgtccctgatccatcgattaaacaagtaatgataaacaaactgggccatgacaataaagaagaatacctgacaatattaaccttcggaggagagatttaccaatatagaaaattaccacaaagacgtagtagattttatagaaacgttacaagaaatgatctagctattactggtgctcctgacaatgcatacgccaagggtgttagttccatcgaaagaatcatgcattactttcccgattacaacggttattcggtaatatttgtaaccggtagcgttccatacatattaataaaagaagatgattccacaccgaagattttcaaattcggaaacataccattggtttcagtcactccctggagcgagcgttcagtcatgtgtgtagatgatattaaaaacgccagagtttacacactaactactgacaatatgtactatggtaacaaattaccattgaaacagataaagatcagcaatgtgcttgatgactacaaaactctgcaaaaactagtctatcatgaaagggctcaattgtttcttgtatcttattgcaagcgggttccttacgaagcattaggagaagatggcgaaaaagtaattggttatgacgagaatgttcctcatgcggaaggatttcaaagtggaattttactcattaatccaaaaagttggaaggtcattgataaaatcgactttccaaagaattctgtcgtcaatgaaatgagatcctctatgattcaaattaattcaaaaactaagaggaaaagagaatacattatagccggtgttgccaatgccaccactgaagacactccaccaactggcgctttccatatttatgatgtgatagaagttgttcccgaacctggtaaacctgataccaattataagctcaaggaaatttttcaagaagaggtcagtggtactgtatctactgtttgtgaggttagtggaagattcatgattagtcaaagccaaaaagttctagtaagagatatccaagaagataattccgtcataccagtggcatttttggatattcctgttttcgttacggattctaaaagctttggtaatcttttgataattggtgacgctatgcaggggttccaatttattggttttgacgcagaaccatacaggatgatttcattgggcagaagtatgtcgaaatttcaaacaatgtcgctagagtttttagtgaacggaggggatatgtattttgcggcaacagatgctgacagaaatgttcatgttttaaaatatgcgccagatgaacccaactctctttcgggtcaacgtttagtccactgctccagtttcacgttgcattccaccaatagttgtatgatgcttttaccaagaaacgaggaatttggctctcctcaagtgccatcgtttcaaaacgttggtggccaagtggatgggtcagtcttcaagatagttcctttaagtgaggaaaaatacagaagactttatgtgattcaacaacaaatcatcgatcgagaattacagctaggtggtttaaaccctcgcatggaaagattggccaacgacttttatcagatgggtcactctatgaggcctatgcttgatttcaacgttatacggaggttctgtggattagctattgatagacggaaaagcattgcgcagaaagcaggaagacatgcgcattttgaagcatggagagatatcataaatattgaattttcaatgagatctttatgccagggtaagtgaacaatacatataaaggatatttaatgctaactagcccgatatatacatctatctatcactaggcattcgagtagtgaataagaaccactacttgaaacactagatttgtaacaataacgcatgtatcatcgtacattttcggaactatttacgtaacgcggggatgaggaaaaagttactttttgcacagcaaaaaaaacaaataaagaacagttagtgaaataaagcaaaagtgcaaacggtgcctttaatcaaagactttgcaggaacataaacaagtgcactaaagaaggtccaatttaaatatgccagctaaaaaaaggactagaaagacagtgaaaaaaaccgtatcattctccgatgacacaacattaacaacgcaccaaaatcgtgagaaaaagaacgtagatcatgatcgtccacctgtgtatgtgaggaaaacccctctgatgacatttccataccatttagtagcactactttattactacgtttttgtatcttcaaatttcaatacggtgaagttgctaagttttttgattcctacacaagttgcttatttagttttacaattcaataaatgcacagtttacggtaacaaaatcattaagatcaattactcattgaccattatttgtctaggtgttacatttttgttgagctttcccacaatgttattaactatattatttggtgcgccattaatggacttattgtgggaaacctggctgttgtcactgcattttgcatttttagcataccctgcagtttattctgtatttaattgtgatttcaaagtgggattatggaagaagtattttatctttatcgttgtagggggttggattagttgtgttgtcattcctttggattgggatagagattggcagaattggccaattcctattgttgttggaggttatttgggcgctttggtgggctatactatcggtgcctatatataatatcggtaatttaaaaatttgtatataaaaaaatataagtatgatagaggtaacataaactggtcctatgcacaattgaaaaatctatgacaaaaactaaatgatctttataccaaacccacctatatgctatttgtaccatcttaaaagaaggtaataacttccatacagataaatagctaacaacattaaatatctcccactctcctcattcttttcttttcataatttcctttttctgatttattcattctatataaaaaaataatacaaatcctcagattaaataataaatactataaaagtctcaacttcttctttaatttgtttgagtcgctttagctacgaatagcctcaaaaacttcgttgaaattctcctttgttaaaccgaaagtatccgaatttgcgtcgctatcaacaggagctgctgcgcctaaaactccattagaaactgtgctatttttcctctgttcataaaaatccgtttttatcagagattctgaaattttactcaactcgtgatttaatttaatcaactgctctgcagatatgccagaaaatccgttattaatggaataatttgaatcggcgctagtcgttaccttattctcctcaagatttttgatatacttggagattgtcttaattttaataatcagattttcgatgagtttattttgctttttacaattcttggtataatcacttaacaacattgcaattttgttgataattaaatgaataacatttttattctttattctcttactattgtcgttattactatgaatatctgtttgctcactgatttcattagcatcattcgtcctctttgaagaatcaaaagacctttgatagagcgccaaaagcattaaaactaaagtttgcagaaccacaatagatttattgatgaatgtgaattcatgaccagcaaatttaatattggctaagttcgagaaaacaaagaacaaggtctccctcgacaattccaaaaagtcttccaaaatttcgttaaatttagcataatttttcaatgtttcaaattgcaataagaggtaaaagttcaaatataacattgaattcctgtagattagagaatccatgatattattaattattgaaggagtcgttaaacatccttggctgacctcgatattcttatttttcaaaagcttgattaactgtataattttatcaatggatagttgttgatctttactttgcaaatatttcatcaagtttacttcaaaatcaatcaattcaaaatcgttgttcaacaaaggatcaataattggggtagaatttgtgaaaggttcagacattagcaacggcaattgacctaagaaaaggtgtctccagcagtagttcttaaatatgaaattccaggtcaaaatatgagattgattttgagtttcatgatttaacgatagtaaacatgccatatgcatatcttcgtcgtaatcaattacgaaagaggacgatgacgacgtgtccatcacaaattggtaatatttccacaaagaaataaaccgcagggtctctatattacacattgaccttttttcaatttcaaatctaagcgttgttaaattagacttcaacaaaggcaagtagttgaataacacattgaataattgcaagtgttcatcatctctaagaggaatcaaaaccgtagaattcaacgattcaaaaagaatcaggagacagagagtaataaatcctagatttagtagctgatcattggtcacactaaaaacttgaaaaatagtttcaaaatctttagaatttggcttattaatggtgttagaaggaaaaagctgctcaactatgggtaatagtctctttggttttaatattggaagtattgaattcgtttccgttatcgtggataagtatttgttgataagggtctgtgttatcgattgtgaaggaaactttaatatttgagatatgccactgttgcgctcaatactgttacggcttgctaccaaatcgtgcaaaggtccattaaattgcgtttcaattaatatattcaagtcattgaagaatttgaataggaaaggatcacgttcaatcaaatactgaatctggaagatagaacttttatttatattttttggtaacagccataatctgtttctaccttcttctgaaatagcagaattaaacacattaaaaactttattagtatccaaaaattgaggatctaaatccttaaattcattaagatgaggtcttctttcactctctggaattggcttaccgtccccgtccgtaacgccgtcttcactcagttttcttttcttaattgtcaaaaactcctcttggtttctattggagtgtgaagactgcatttgcgctgaggaatcctgcttgagatcaagatttactcccgtaattttcttacctgtaatttcttgcaattccagtagtctgcctttcaagaaattcatttcatgattgatgatttcatcttgtgtgtaaggagaggttagcatatgaaaaattgcagggccttgaacccaattgagtggagtagaagattcgtttgcagaagtgactggcttactttccaaggaaggcactgattttggaatatattgagtgtgttgttgattcaaggttgcatttgccgcagatgatctattattaagttgattttgagcattgagcagttgcagacgcgtgttgtattctcttatttgctccaaagaagccagttctggatttttctgcaaaagtgcagcagtttccttggagacacgacgagaagcgtaataagagtttaagtacggaccgttggctacttggcgtgtattggaagaggaagaactagagggaacgtattgtccgggaacgtccggataaaagcagtccattttattatgcttcatacagttcccacaaatcggcttaacacgatcgcagcctatcttcctcttacggcactgcacgcatgcaggcggttttttcatttttctaccacgaatatccatcgttgttttttggttctgaaatgctatttttgtagataagagcttaagaaaatatcacagaaacctcgattttaaatatctgcgtagtatggggcaattgcagcagagcaccaatgactttggtttgaaagccgtgagttttgatgaaataatctaatgtaagcagctaatatatcttctcgggcgaaaacgggaaagtggtcttacaagcgtctaacgggccgaatgaatattggtgaactatggctatttgcgagaaggtatagcagtggaagtgtccagaaagcagtatgttcctaataataaaggtagttcttggtctgtgtgatcccagctggtcaacaagacccacgttggtcaattgaaatactcttgtgaagttgtgccagaaaagggccatagggtaacatactcgttctatgtgataatcaactgttataagcactatatagttacatagctggcctatacatctcctgaatagtgatgcagtttagagttcatcgtgggctgcttcgctagcttccgctttgatctcttcctgtagcttggcggcgtctttattgtccaaaggaacagtttccagttcaccactttccacaataataacttcctttacaggcatatttctactgtcggtcttaacgttttcaatgtagtgaactacgtccataccatccaagacttctccaaagacaacgtgcttaccgtccaaccatgggcatgggacggtggtgatgaaaaattgggatccgttggtgtttttaccacgattggccatagacaatctgcctggtttgtcatgtttgacatcaaaattctcatctttgaacgtgtttccgaagatagacttacccccaatacctgatctgtgagtgaaatcgccaccttgaatcatgaagttaggaataacgcgatggaagatagagttcaaataacccatcttagggtccctggaaatggtcaactggtaaaagttttcaacggtttggggtgtggtgagaccatacaatcccataacaattctaccaatttgtttatcaccgtgattaatgtcaaagtagaccttgtgtgtgatctcaggatcttctgccgtgtcctctttcgcaaaaatggctgttgtgaagagacaagcaaataaggtaataaaggaaaaaaattgaagcttcataattgcggatatcgctgtgccttttgtttattgaattgaaagtaacctttactgttgagtctcctcgaggaaagtagtaaggatggtttcatcttttttttcctctgctaaaagggattcgctgcgaaacgaaaattaacttccctactattttttatatcgtaagtatgaatctattatttattgaactataaccattgtgttaaaccaggatcagaagatacaaattcttctagtctggcttgaagatcctcagcttcttttttcatttcggttaaagctcgaaccttcctttgactgtctggcttcaagacattaggaccttgtgagagttcatccccgtctacagtggccgatgtagagttattttttcttgcttgcctaccaccaacacccaaatattcgtctcttcttccttgccaatcagtcaaagtcccattaccatcccaatgatctaatttatcgtatattaaatcccctacattgtttattttataacgtggaataatgtgtgtatgcaagtggggtaccgactgtccggcctcaggtccatcttggatggcaacgttgatagagtcagccttatattgccacttaataaatctatgtattaactgtaaagtcttgaaataatcttgagattcaggcatggtcagatctgataagtttaaaaccgtagttctcagtggaacgatcagtacatgtccgggtacaattggtttcaagtttaccaatgcatacgtatattttgacttctgtaaagaagcagagattataaggtctccatatagttagtaacgcaatggtgcgaatggggtacaaaaaaacatatgagagtgcatacatagaaaacttgttcagttacaagaaacttgctgaaatatattggcttattcatgcttttaggtttctttgttttgcttaagatcattctgagcccaagatagatcaatggagcttcctttttttcttcgcttcttacaattgagcagaaaagaagattcgaccatatcttgagaaacgtataaaccaggaaaattacacattctaattggtgtcaatggcaaaatatatgcaagtttgcatgtaaaatattttttttaggccggataaaataattcttcctaatagtgtctaaaagaaaacactgactcttataaaacaaacaatgaacattttaataattaagatataaactgccatcttgatcttccaaagagactaccaaatcagcgacttcatcgcttttcatgttccaccccagcttgggagaaacacaaatattctttaggcagggcagcctggattccagtatggctatagtcaagtcatcgggatgaatcttagaagctaatcccaaggatccgctgcattctaagtacaatgttttaagaggcctatcatattccaccaatttacttagcatgaattcagaaaagcaccacttagaacagtaatcaaccatgagctgcaaagaaattaaattagcacagtacgtgaagacatggtctagggaattttctgccagagatggcatcggataatgaaaaaataaatgctttaaattatcaccgatctgtgataacaacgaataaatagacaattccgttatttgaggacaataagagaattctaaagttgtaatagttgttggccatttcgtatcaatcacaaattcatttgttatacctccactcaatttcaagtacctgagattctgtggccattgaatatcttggaacccttggcagtcaatcgacgatctgggaaaagataaatgcgttaatttagtgaaatttttaatggcagaaaataactccttcagcttaactgtttccgatactaaacccaagtctaaaaatttcaaatcatgacacgatttcaatgaaatcaaaggcgcgtaaccaaagcttgtctgtggtgcgatgaatttagttaggttagaacagcatcgtcgtaaaagcttggagacaaatgaatttctaccactttgtaaaattgtagacaagttcaactcaaaaacatagtgtcctaaattcttctttttatttatgattattgtatcaacaaacccgttgaaattcttacttgttaacgctggtgcataataaagctttggtagacacatggcgtaccagtttctgcaaactagtaagtagttcatatttataccagtcgtagttttttttccattagcagttttatttaatttttcttctttctctggtatatcaagataatgaattattctatgctgtatctcccatggcaaaaccatctttactgatactgaatgcatcctcgcttcctcactctctatgactttgccatttttttctcctttggaggacgatgtcgatgatgacgatggcgactgcttacgtccttttttatcctttttttcattactcagtcgtgtcaatttcactatagtatcattggtttcatcatagtaataagacccctgtggagtctcaatgagttctgcatcctccggtatagtgatagtgaattctttagccttattatcatttcttgtagaggagaaaccctctcccgccacgtacttcctgtaaggagccttgattttcttgggtcgtgatttgtttgccattactgagtactgtggttgatatgattatgtgttagagctgttgcacatgtttgtcgatgtacaaatcttgacgatgccgtcatattactctcaatactagacacatcttgtattgacaacccttacccctcatgaagaggtaacccggccgcagggctttaacaataaaatagagactatcattcaacaattacacagtagaaaaaagtcagaagattactaatctcgatcttaagtctattagtcaattaaatgtggcctaggattcaactaaaaatatagtagtagtgaaaaaacaaatgttccaaccgaggatcgaactcgggacctttgccgtgtgaaggcaacgtgatagccgctacactattggaacaatattacggatgacagcttaggattcataaagaactaataaaggtgtggcaataaaaatggtgcagcaagtctcaactttactgcttcttatagttacttcctgtcgttttcatcacactaaccctttgtttcattgtgctccccttcccttcctttcaatattgcttcctacatcggtcactcttactttggtaatgaagtaatgaagaaaggaaaaatagaaaatcgaatactaaaaatgttattatttaaggagaataagaacgtagacacttaagggcgatagtgtttgaacagaaaaaaattaacttacaaaacatgaaggacttgagattacaggggccctacagaaagtacattccctataatattttccaacaatgtggaattggtcacttaaagacgcttgattatattttcgcgtttttgattgttattaccaatttcacattaatatggaaatcgcactcttcttcattctggaaccgaccatgggacaataatagtgaacaagaactttcccaattaattcagttttacctagacaaggctttttacatccatgaattgccaccatttacaatacagttctactccattattcgaagattaaagatcgcagaaaatttaagatacgtttctttgtttttgaattcatcgactttaggttttcttttcctgataacaaggagaatcaattgctctcgtttaatttcagcaacaggtttgctgatattatccaactgggaaactttcagaaatgagggcactattatatcatttgacagtttagaatggtgtctgttctcagtagtaatttacagttttataagcatttcaattgcaaaactgggaactacgaattggtttgctaatgtgattacattatctatttctttagggctggcaatctcttctaaatttattggaattgtcacttgggccttcgtaattctttcttttgtacgtcaatttgatagactgataagcgacgttaaagttacgaccatccaaataataaaatttgtcattctctgtctattattcgttttgattatccctggttccatcttcataataagttattcgaacttactttcgaattttaagacagacacgccacaattttcaaaatatatgagcacatatttcaagtcctatttaagaggccctcaagtacaaccgagtcgattgtactatggatcaacgatcacattacgtcatttagattctatggtcggatatcttgcttctcacgatatttcgtatccatcagatgttgacgaacagttagtagcgttatcatttgaagaattcgcggcagacaatgaatggttaatagaacatcctacattaaatttgagtttttctgaggtataccatgctgatcaattgatacctgtagaatttggtcaaagtataaaactaagacacaaatctactggaaaattattgagagccagcactgctaaacctcccatcagcgagcaggactatgactttcaaatttcatgcacgaaagattcaaactacgaaggaggaatggatgagagatgggatgttctcctgattaaagatgaaatcaacaatgataaaaaggataacgcagatgataaatacattaaaccgcttcaatcagagatacgcttttacaataacggccagagatgtgggctattgggccatgatcttcggttacctgaatggggccgctttgagcaagaagtcctatgtatggagtacccagtaataccaagaaccacttttctaatagactcagtacaactaccagtcgatttccaagtcccaatgatagaatattatatcggcaaaataagttcttcagcagaattcaatcataccttatcttggtcacaatttctttatcttttcaaagaatatattttcaaacaatacaagtacaattactatattaaatacggtaaaaataaggtcacttttgaagatgcgttcgccgtggaaaaatggccaattacgttagacacagactctccagtttggtttaattttgcatggtatggatccttactctcgatgatcattttcatgtgcgtgcaatgtaagagaatgatatcttggaatccgtggacaactgctgaaccttccttttctatcaaatgggaggtctacaatgaatttggctgggagtgcattgtcggttggtttttacatttttacatcttcacaatgagtccacacttcaacttggggaaaaaactgtacttccaaagttttttctttagtgtattgtgtcttttagaatcgttagattgccttgcaaagtaactcgtagaaagattttctccattatgatttttctcccattgcttcaataattctccggtacaaatagagtagcacaattatttataagaataacatacatacgcttaactctgccatataactatagtacattttctgtcctctgttcgcaaatttctttgtaaaacttaagtttatgtgctcttttttgagtttgcaatgccatctacaaaatcttcaattaaagaatcaacgtgccttaaaagtttctccttctttttgatggcctcaattttttcgtcttccacttcaactagctttttctgcaacatatcaatcttccttaattgctcttcagctgaaacgtcaacaccaggtaacgagtcaataagcttgtttatctgtcttgttttaagtataatgtccgtggatagctcatctatcgtgttagaaaattcctcaggaggtactactgtggcatgcttatcggacatctgaggttcatttacggtcaatcgttcaaaaccatggttcttatctatgtagtttaaagtagcacagaattgctccgtcatttggtctaaacatatctgcaattgtgttaatctatctgtcattgttaaagagcatataatgtattgaactagtgaaatgttatgtccctcttttaaccaatggtttaccgtttgaattataattatctttcagaattgattttttttctaactttcttgcaatgcgaacaaagcttgtaattaagcacgtacggttggcctttaaaggattacagagaaagacaaggcttctacagaaacagccacatgttctacaaaagcgcacttcacgcatataagcatataaatgttagttatatgaacaatcttaagtaatatataataaatcagaaaagtttaactgtaaaagaaattgtgttttaaaagaagatataataaacgaatgtatgggataacgccaagttaaatgaatgtccttgttttgtaactaaagcagaagaaataatattgttagctctagttattttaatagtgaaaaaatagccgaaataaagaacaaagaaaaaagaatgaggaaacgaatgaatgagattaacgagtaaaaaacgaatgaatgatacttcagatggtccttgaatatgttttataagctgattctttgaattttttttttttttttttttcattttctgtccttagcttaagtttgcaggggctcgagctggttgaaagaataaagaacatcatcgaaagattttctatggtttacaggggagtcagagtaggaaaatttagattgtggagaaggcgtagctatagagtttcttctcttgggaagagggctttggcgtgaaggaaagaaggcttttgctgagtccttatttgagtttggggtctctaaaaggctacgataagcgcttgacctctgagaacgaggcaagaagtctaaaataggcttatcttcaagtagtgtggggaagttgtagttcttcaaaaaatccagcgaagactcactagaatccgtggaattagtgtatctatgacccagagcgtgtgacttatttttaaattgttttggagatgcgtttggggaatactcaaaaatagatgtagccatagttgacgtagatacgactctcccattaatggaatgattgtttccttgtgtgtttttagagtaattggaggacgttactgagatcgaacgcgcgactgatagtcttgatgtcttattttcgtgcgatcttgaaatgagtttgctttcacgattagcagggatcctttcagtgacaaaagctttatttagtgatttcgaatcccgcttgcttgaggaggaggtatagtcgtccttaatctctgtggacagcgatgaaggttcctgcaattgctcatcttggaatccatttctagtgtcagcatgtgaaatatgttgaaaatcaaatggtgtggagatacctttacctcttatgtccggttgggcaccaagcaactttttcttcaacaaattaagcttaaggaaaacctttttgtgatttgtcttgttggcgctggacgatgatgacgatgattctttagactttgcagagttagaattacttctcctgtggtggcaagacggatgtgaatttggtgaaagtggaggcaactcaatgtttttcttgttactcagcacaggtttatcgctgttgatgaaagtaatgcctaggttttcttcatcatcagatcccatgaattgctgggcctgcagaccgtagagtttttcagcttcttcatcttcatccagccaaatcgaccgcatctgtggaaggttcatggtttcgtttccagtattggtaatacttgcactagtcatattcgttcttttgatagcgtattctgtcaggtattccttttgttagtgttaggtgtttcggagcgaaagatcgagttcgatagcataaaaaaagaagctctcttgagcagtagcaataatatataccagacacgaaacaatccatcaacaggtctcgttttactggagttttacattttcagtttctttttcggatgcgaatgatcactagcttgcaaacacgaattgatcacgtttcacaattgttccaccaaacatggcgataacggcagcgtttcctcgagaaataggcaacatctagatctcgaaatggttggtctgcacctgtttctgggtgaccaatcctcggagccattccagtgcttaagtcttcaggggccagaacgcgtctttgccgggtgccgcattcttttggcccggtcgcgcctgcccaaagtagcaatacacaacacccaaagaaggaatttctttttctggaatattaatggagcggagccgcgcgcttgctgaacgccaaaattataaaaacaaactttgcaggtttttgaatctgacgcagtcaatcatgtttcttttctcgtgtaggttaatatagataagcgcccagcggtatgctttttgcgttttttgctattttgagacaatggcgatagtttaagtttcttagtatgcagaggtgcttttgtacgactggggcgttcctcagcgcaagagtaagaaatagttacaaattcgtcgataaaggtgtatgtaatgttaagcgctaaatatgtatgtaatgttaagcgctaaatatgtaatgttccaaataagttgggaggttacttggttgggcatagtaacggtccattattttgtgttttttttatttttttttatttttcatttttttatctattctcgaaactgccccaacgtacggaccagcttaacggatatctggcggtatgattctggaatatttgacctggttgttttctgaaccgtcatcaaggaagtcaaaaattaacatgttgtcgatggtttcattcagattgtcttcgttaatgccgtcctgacccaatgccggcagtgtttcgttatggggaaacatccactctctccattgagtggtcacattgtcgcagaggtcgtagaggatcatttttagcagggtaatatggttgtagaaccatgaaacggatcgattaataaatattctgtagttttccatctctttcaccgcatgcaggatggtgtagttgtggaatcttcttttgtctcttgattggtctctccaaaattcgaaaagggcaaataacgcctttctcctttgccaggttcttttggattcccgaagttttaagcctagaccaactagtttattctcccacctgaattccatcaagaagtactccaaactgttaacgtatttctctgtcagcgttgtcttgctcaaaatttcaaaggcaagttccgtctcttcttgaatatcaggcttgaagaaatgcgcattcattttttcatgctttgatttagcagcataatcctcctcattgatgctagagttgatcaattcctcttctttcgccttgaatttaaattccaggtacgctcctgtggtaatgggaacgtccggaatatctctccggtagaagaagccttcccggcagattaattcaatgggagttgccgttaacaatgtattgcgtgactctgtacccaaaccgaggtttccgttgccattgctactatcgttagcagactcagtatcgttatggatagatgaagtacctttggataaatctgcggagatgtctcctgagacattctccacggtggccagcgttccgctattaccaacacccctttctccctcatcttcttcaccttttgtatgatcttctgtgcgtctcttctttggtgatatgctcgtattctctgtttgatccaatgcaccgtcatcgcctgctgttcttttccttatcgtgtccgaaggttgtgagttttctaatggaacgaacgtggtagtttcttcatctcccggggtctttctttcatattctgcattctccttggtaattgcctcttccccagaatttagcatggactgtattccaactttgtgaaccgtatcggcagcggatatggttagacccatcttgagagagtcgctgtttgcgtttgagccctcattgtcaatatcgacgagtttttcttgctctaatggttgatatccttcctgttggtggtctgaaatgccgctgatggaggccgatcttggttttggcgacattgaagaacctttagttgttggtttttctgcactttttatctttgaacgggtggagatctcattcaaatttaagttcaagtgattatcatgtattatcgaagtcattcttttcctcctctcttcttctttcattgcttttaagagtttcttattagactccataaatgactttgctttatcgcgatcgttatatttcatattaacaagcattttctcccttgaatcacgtcttttatctaattctctttgttgtctattcatctctgacgtaaccgccgcagcagcggcagctgttgctgctgctggagaggaaacgggtggtaatttgaccgtaatattaccgctggcgtcataacttaatgaaaactgatcgttaaccattaatcggcgaatatcactattgatatctgaattagctgaaaatttaatgacgttgtcagtattattattattggtcgtattattaccactattttcgctggatgatttgatggttattattttctccttctcggttttattttcttcaacatttacctttccttccacgttattatgaacagtatcagtagtattcgaatcctctgcgtttggatcaccattagttgaaattagagaggccagttctaaacttttaatgtctatttcttgtgtggctgaccttgaagtccgaaccggagccggttgtgacacaggattggatggagatgatggtatttgatgaaatttggaagatggaagcaaggaatttattggaatctcgtttttaatccgattagatgcatctgacttatctatcgtatccgtggaattggatatcattgtttccactgttctcttttttgggggcctgcctctttttcttttgatttgaattaagttgttcggcgtaacaggtgttggtgtgatggagctagaattagcagtggatggtcgctctttaccattttcattgttcgttctttgcggtacggaagtcaaggacatatcagcatcatctcttgatgatgaaggggcagataataaaagcgactcttgtttcgttgatggttccacaaaataccttttggatttagacgtttgtactacggcagtcggtaaagtaatatttactggtgagaaaggagcaccctgattggatgcacttttgagattgaccgaggctgcgtttgacactaacttattcattgtggaggtcgaggcatcttttcttggcctgccaggtccccttcgagaagaagaggtattatgctgtgaactggtattgttggatgaattttctatgagaaggttagagtgatttactttcgaagtattttgcaacattgtcgataatttgttcaatcgttcattcaaattattgaccaatatgtcagtatttacttgattcttcatgacatcatccagcttattttccaaaactgattggttgtgtgataaaacttttaatgagttaaacaaatcctgcacagaatcagtgagggaagtgtctttggaaagcaaagccgtcttcaaatcgttgcattgttttgtgactttgtccataccctcttttagggcttcaatagatgaatgtggaaaggcctcggaatcttttatatgaagcggatttgaaccaaaaccagagccaacttgtcgttttatatcagaatcatcactgactggtatgtctgtgatggatggcaaagctttagcgttcgcatctgtatctagcttcctcaaactattagcttgattttgagcactggtaagtgctaacgtatctacgtcatctttgggtccagacggaagtctctgttcattggttatgttatcagaaggggctgtggtgttctcagacatccccgcaacaaacgaattttgttaattatgtatgaaacttttcgtttgatctcaataataccactagcgactaaatttttatgatacttagctactttaaacaagtcccttgtgctctgtttgctgacacttttgataaaatatgcctgtgtataattcttttagcagtttatttcaaacacaaatggtattaaaaggatagatgaaaaaaaaaaaaaaaattaaagccactagtaatgatacaatcgtggtatcacaagcgctgaatgaaacaagtgtggctatctatagcggatgcaagtggagaacttgtgaatccaaactgaaatattttgccatcatttgttgtcctttcccttttccattcaggaaaaaaaaaaaaaatttgacgtcgccgtcgcgtcgcagtcatataattacagcaatttatcttgttgaacgacgcaaattaatggaaattgtgacttacatagtaagtattagtaaacgtagttaaggccacgtgggaaagatatgaaaggagtgtaagtaatggatatcggtctaacgaaaatggaaaccaatctttaaaaatgatagtatgattcgacagtaaactagaaaagccacaacccgtgggacatgataaggctgctcgtttttgacgcaatttttagacaatactgaaatttagcataataagctttcccagtgaaagtaataatatttaacctagggtaggggtagggaaaaaataaaagtaaaccataatgtcacattccggagctgccatttttgagaaagtttctgggataattgccataaatgaggatgtttcacccgcagaattgacatggaggtctacggacggtgacaaggttcacacagttgtcttatccactattgacaagttacaagctacccctgcttccagtgaaaaaatgatgttgaggctaatcgggaaagtggatgagtcaaaaaagagaaaagacaacgaaggaaatgaggttgtgcccaaaccgcaacgtcatatgttttcgtttaacaatagaacagttatggataatatcaagatgacccttcaacaaatcatctcacggtataaagatgcagatatctacgaagaaaagagaagaagagaggagtctgcgcaacacacagaaacaccaatgagctcttcttctgttactgcagggactcccacaccacatctcgatacaccacaattgaataatggggctccgttgattaatacagccaaactagatgattctctctctaaagaaaaattgttgaccaatttaaagctacagcaatctttactgaaaggaaacaaagttctaatgaaggtttttcaggaaacagtcattaacgccggtttgcctccatctgaattttggtcaactagaattccgttattgagggcttttgccttatctacttctcaaaaagttgggccttacaacgttttgtcaactatcaagccggtggcttcatcggaaaacaaagtcaatgttaatttgtcaagagaaaaaattttgaatatttttgagaactatccaattgtaaagaaagcttacactgataatgtgcccaaaaatttcaaagaaccagagttctgggcaaggttcttctcttcgaagttattcagaaaattaaggggtgaaaagatcatgcaaaatgatagaggtgacgtaatcattgacaggtacttgacattggatcaagagttcgacagaaaagatgatgacatgctattgcatcctgtgaaaaaaattatagatttagatggtaacatacaggacgacccagttgtacgaggcaacaggcccgacttcactatgcagccaggtgtggatattaatggtaatagcgatggtaccgtggacatcttaaagggtatgaatagattgagtgaaaaaatgattatggctttgaagaatgagtattcaaggacaaatctacagaacaaatctaatattacaaacgatgaggaagatgaagataatgatgaaagaaatgaactgaaaatcgatgacttaaacgaaagctacaagacaaactatgcaatcatacatctgaaaaggaacgcacatgaaaagacaaccgacaacgatgcgaaaagctcggcagactcgataaagaatgcagatttgaaggtttctaatcaacaaatgttacaacagttgtcattggtcatggataatttaattaataagctagacttgaaccaagtagttcctaacaacgaagtcagcaacaagatcaataaaagagtcataactgcaatcaagattaacgccaaacaggctaagcataacaatgttaattcagcactcggctcttttgtcgacaacacttctcaagcaaatgaattagaggtgaaaagtaccctaccaatagacctattagaaagttgtagaatgctacacacaacgtgctgtgaatttctaaagcacttttatattcattttcagagcggtgaacaaaagcaagccagtaccgtcaaaaaactttataatcatttgaaggactgtattgaaaagctgaatgagctatttcaagacgtccttaatggtgatggtgaatctatgtcaaacacatgtaccgcctatttgaagccagttttgaactccattactttggctactcataagtacgatgagtacttcaacgaatataacaacaattcgaactagaaatataaaggctctccagttgttaccactttttacattcatatttttcatctatttactgcatgttacatattacataaaacttaattgtgtgtattcttcctttttggtctttagtctctatgtaaacaatagaaaaacgcgggactcgattaacgctgtgctgcactgatgcagccgtgcgtgtaaataaaacatttaacgtgaaaacgcgcgcgaatggcttgtgaaacaaacaagaaacaaacgggaaatatttcagcatgtgatgtggctgaaaattagcaaacgattcgtcaaaataaatcagtaatggtgctttagttctattacagcttgctaatggttcagtaatattttcaaaaattttgccaaacagacctaagcacttgcaatactccagactgttagttcagtcattatctatcatcttggacgattttgcaattttttagtgtagatgcatctcatcgacgggcttgtatgaatgatattaaataggcaaaataaactagtctagctaatattcgactaaattgcagctgctaggtcaccatcccgcacataccttagatattttggaactaatggctaaaagaaggcagaaaaagagaacgcatgcgcagatcacacccgagcaggaacgagatattcctaaatccatggtaatcagagtgggacaaacttcattggctaaccattctctaaaccaattagtaaaggattttcgccagatcatgcaaccgcatacggccgtaaaactaaaagagcgcaagtccaataaactgaaggattttgttgttatgtgtggcccattaggtgttacgcatcttttcatgttcactcaatctgaaaaaacaggaaatgtctcgctaaagatagctagaactccacaaggtcctactgttacttttcaagtattggactattcactgggtagagatatcaaaaaatttttgaagagacctaaatcgttaaataatgatgatgtattaaatcctccattgctagtgttaaatgggttttccacatcgaaaagatctgatgaagacgatcaggatgtaaacgtggagaaggttattgtttccatgttccagaatattttcccacctctgaatcctgcaagaacttcgttgaattctatcaaacgtatatttatgatcaataaagacagagaaacgggggaaatttctatgcgccactattttattgacattcgagaagtagagatctctagaaatctaaaaaggctttataaagccaaaaataatctaagtaaaacagtgccgaatttgcatcgaaaagaagatatttcttctttgatattagatcatgacttaggcgcctatacatcagaatctgaaattgaagatgacgctattgtgagagtggttgataatcaggacgtgaaggcaaaacattctcaaacttcgctgtcgcaaaaaacacccgttaaaatgacagataacgaagaacgtgaaaaaggaattgaagaagaagatgtggaaatggaggaacctaagccttcagaaaattcgcaaccaactccacgtaagaaggctatcaaactgactgaattaggaccaagattaactctaaaactggtcaaaatagaagatggtatttgttcaggtaaagtattacatcatgaatttgttcaaaaatcaagcgaagaaatcaaagccttagaaaagagacacgctgcaaaaatgaggctgaaggaacaaagaagaaaggaacaagaagaaaacattgctaaaaaaaaggctgttaaagatgctaaaaagcaacgtaaattggaaagaagaaaagctagagcagaagaacagggtgaaggtcaagggaaagatggtgcaatgagcgatgatggatcttcatcgagtgaagatgagcattatagtgatgtaccagaggatttggatagtgacttattcagtgaagtagaataatgcacgatatgtatatatatcctccgtacgtaacatcactatccatatagtagccatgactccgatggacttaaagaaccaggaagtgtctgtttattcataggtgagggaacacctcaaagtaaatattaatgaatatataagatcataattaaacaaatatatagaaatcttttacaattaaagaaaaaaataaaagaaaagggaagttaaaacttcgattattaacagctgaaaaattaaactttgtaatgaaaagcaaattgggagttatcgttaaaatacggcatcatggaaaggacaaaagttccttttaacaaaagcatgtccatttcccttctgggctgcagtcatttgcgcccttttgtgaaaccagttcttaatacacttataatggaaaacacacaagcattctagtctcccaactttctcaccgggttccatattctcaaaacaaatcgggcactccttaattgcattatctgttgtattaggcgatatcttgtacactaacattctattttgaaaggcagggctttcttttacggagtcatctgctgcatctgacgtattcgtatgttgttgggcattttcagctctctgtatgcaatcctctacgtgctttctggtctcttcttcatcaggaaactgtgtgagatctgagttacaaatagggcagaagtgatcctcctcgttttgtgaactttcttcgctcctgcatgccgtaccggattgatctaccgaatcttccaggatttccgcgtcttcatcagtgttgctatctggtgcagaaagtgcaagtgcatttggtggtaccgaagtttgcgatagtcgtacatctctgttggtggaggatactagtagatttaaatgaaggaggttatcgtagcactcattacaagttctatatggaggcgattccacgtcgctattttttttctgcaaggcatggactctctttttattataattaacaaaattttcggtacaagacgaacaaaatatccttccacaacacctacaatggtgtcttcttacgagaaacgaaaagttcgtcttgcattgaaaacagctgtgagcttcctcgtctgcctgccacctggcaagattattgatacagtcctctttaataaccatgcgctttagttcttcatatgttcttttctagcagaaaaaaaaaaaaaaaaacagcagtagtgtacagtgtttgatcaggttatttcttaatcgtccgtcccctgtttactataaatcccgagaatagttctactttttcttttctattcttctcttcggtgagctgcttcgatgcccattacccggattccatgatactccgctatttcactggcccttatcgaagatttccttctccagagatatgattatgcacaggcttccatacgctctatcgatcgtgcaaacatttataccctctgcgaaacagcgtcgaatccattttactttagaaaaggtgaaatacgatgtagtcaatggtcgtccaacgtttcttcattatttccaacattaccgtactcagcatttaatcgatcgttaactcgtagctttcttaatagaatgtcccagaacgagagtcccagtagtactttagtttgctgcttcaaaagctggactgctttatagtctgtctctttgactagaatgctttcaattttcggaatggcatggccttttttctgtttaaaatcaaatccacttaccacatccaaatacttgattttttgcatctttcttttacctttgttatactcctttatcaggcatttaatatcaacttctttgctaagcggtattaattcaaatccatcaggcttagtttctttcgagtaaatttcgatgttgccaaatttatttttataatgcgacaaatctgttatcacatgttcctgtcctaaatgatcgcaatacgtgctggggtatttaggagacttcattgtttgctcatacgaaaacaattctttgataacgtacttgtctaggtttcttaccatcctttccctcatcggtagatactttttacgttttaatggttgagcattaggtagaatggaacgccctaatattgcccagtgctgtttactctttaattgaatgacgtctcttctccaaaatatgggctcttgtgaattgtctcccttagtaaatgttgcggcttgttttgcacatgcttttaatacttcattagactttaacagagagggaatcacgaaattatctgttcttttaatctctgtcacactctttggtaatgtaaaattagttaaagcaatctttttcattattgcgtaatgatgaacagatgcttttttcttgttcaagactttcaaccacttagatagatattggtagctagtgtaatgcttcgatttcaaaataggagaagactcagataattcaaagtacctgtaacaaacatttggcacatatcttggtgaaacatcttgtagtaccttttcagcatgattgatacggactacataatgaaacttttggtttaggttgtacttcatgtctaccgaaggttgataagtagggacaaactgatcttcgcgtgttttcaagaccatttcacgttcacccagatgggctatagggtcaatgatgtataattcaccatcgctcaaagtaggaacttctaattcaatccaaaaataaggttgtattaggtcagagtcaaatctgttgggaactttgccaataccatgttcgatttgccacttcaccttattgcacctaatatcgtaatcgtgcaagggcaaggcaaagcataagtaaagcttcttaggccccggtagcacattttctaagataataaagaagaacaacgttagaatatctctgttggccattttccttttagccatcttgcgaatatcttcaacaccatgatttatcaacggcctatttccataaaattcttgttgattttcaagaacttttttatatgtagattcagagattgaattttcgttttggttatcggcatacttgataaggtattgcagcctgttgaaattctgtctaatgccattgctattcattttgtaattggaacggaaccataagaccaaaccaagcaaaagggttcttaaagaatccattttaaaagctggatcccttacatcccaatctttgaattttttgccaattaattttggtacagaccttcttagtcgcctatttagtctttcatcgtctatccatttcatcctagattttaacaaaaataacataaatggaatcattatcaaatggagtccatatttaagtcgctgataattgaatgcttttttattatgctttcttttgtacttgctgactttctccctgtctctgcgtatattgccaaatgtgacagttaagcttccatctaaagaaacttcttcccaatcaatatcacttaaatcatcttcttcatcctggtaaaaactatcaaaagaatcatctgtttcttcctcctcataaaacgatacttctttcttctcaatctttgagttttttcgattggcctgatcattttggcttgattctaacagtctcttggccattacttttcttctcactattccttaaactcatgtatgctaggtttcaaggtttgacccttcgttgaatatcgaatttggtcattcaccctggcttgtgtgttttccgttttattatttacattttccagagggccactagaaaaaaaaaatacttatctatccatatattttacaaatggtaatgtatgtgcatctgccagtaccaaaggtggaaagaaaagtatacagtttatttatttgaagtatgataaattttttggcttgatgtcaactggctgtaagtttttgtccaatgggtccatttttcttttggctttagatctacatctattatattcacgtgcaacgcattttcagcactgttccattcaatgaaacatgtcacgtctctgagtgtcatgagtagcagatgctcatcgtttacatcgttgattgattttatgtcacttattggagttgtgttctttgtaagttttttctgtaaatcataaaggatcttgaaaatgttattgtcattgcgcaagtactcatgcatggcatctttaaacttaaccggaaatatattacattctccaaatattaattccaagtgtgctggattcattagtaattgattgtaacagtacttagtgcctctacccttaaatgcattatgagtacagttcctacagtaatctgtatcatagtataaccatttaggcttcaattctaaaataactgtttgcagattttgtgaacaataagattttaaaaagtggttatttaatatcagatttgaggtattattggtgagatttttaattttgataactttgactaccttatcgtctaaatttagaataaagtcactgagaattggccttatagcttctatatcgacgtcaatcagatacatcgggcaaagcaagccatgtagaagaggttctacataatctttaatataactgatgtttttgattgtataagaattatttgatgataacagatcgggccaacggatgcagcatcgccacaaccacgtaggatccccataatcaatcagtatatttgccccaccacgtccgatgacttgcatcgatctttcttttcaaaaaaggaacttatctctgacaattttcgactggtagcatatcacggttcgaattaattttggaaaccctaaatgggaccgcatcaaaaaagtaccttgtgaaaatatcttcgataaataaaccactgaggaacgaacaagaaaaccataagtaagtgaggatgatcgtatttcgtcgctttcctacgtgccttttacatcacattcgacaaccggcatccaggagtcttttgttggaatcacaaaggcgatcattatcttttacatcttataaatataacagcagccacattgatgatgataaaagtaaaaaaaagcttaaaaatgttttccaaatgaatagcaatagagtcattcgtaagcaaaaaacaaaagaagaattggccaaagagaggttcgaagaacaactgaggtcacctaatagatttgtgaggtggggagctattgcgagatcagaaaagttttcaaagggaatgaccaagtacatgatcggtgcttatgtgatatttttaatctatggtctcttctttaccaaaaaactgtttgcgaaagacaaagaactggaaagattgttgaagaaacaagaagaagggaatgccaatgaatacgaagcattaaggattaaagaattgaaaggaaaactaaggaggagagatgaattgaaattagaagaatacaaaaaaatgcaagaagaaggcattgaaaacttcgatgatattcgggtacagaattttgatcaaaacaaattgaatgaacaaatattgccagcaagagacacaacaaacttttaccaagaaaaagctaacgaatatgataaggcaattaatatggaagagagagtaatatttctcggtaaaagaaggaaatggttaatgaaacattgtcaaggggatgttttggaagtttcatgcggtacaggaagaaatatcaagtaccttgatatgtcacgcatcaactctataacattcttagactcttctgaaaatatgatggaaattacacataaaaaattccgagaaaagtttcctaagtataaaaaagttgcatttgttgttggaaaggcggaaaatctagtagacttagcagagaaaggtaagccctctctagagaatgaaaaggaaaaccaagtaaaatatgatactatcgtggaggcgtttggtttgtgttcccatgaagatccggttaaggcacttaataattttggcaagttattaaagccagatggaagaattattttactggaacatggtagaggtcaatacgattttataaataagatattagacaacagagctgaaagaagactgaatacttggggctgtcgatggaatctcgacttaggcgaagtgttagatgattctgacctagaattggtggaagaaaaacggactcacttaggcactacttggtgtatcgttgcaaagagaaaaggtgatgtgaaaaagaaagacgagcttgggtttgtagaaaaatacttgcaatcaagtattagaaagagaatggaatcattcgaaaaaaaagacgatatggcatctaaaaaagaacttgagccagtacctcctgtaagtaaaagttaacatatttattcataccaatgaattttatacaggcttagaatcgtgtaaatatttcagtaagcaagttaaaatgtgatctaaaaccccttaggtagttctccttacttctaaagtgatcatactgaccatatgtgacgtaacgacgctattattaacaatccaaaaattgcgtcactgggaaaaaataaaaatgcgaactctgtggatcgaacacaggacctccagatatcttgaccaaagttttttcttcagtctggcgctctcccaactgagctaagtccgctaacataagacggaacttcatgggtggtctgtcttttatatatgcaatcttttatttttattgcgttgcggttttcagtattcataagaaggtgaaaaatgaaacagatcgttgtgatcaaatcgctcaaatcggatttaaattaaactttttcttctatttcaatgcatttaattaagataggtaactcttgtgaataagtgttgggattgcattggtgataaatccataattaggtacacagaatattcatgaagttttttttgaggataaaagaatccccaaaaaatgagattggtaaatcttgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaatagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttaagatacgatgaggcaatcacctataataaagatattaaagaaaaggaaaaatatatcgaagcataccacaaagaagtcaaccaactattgaaaatgaatacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccgagccagataataaactagtcgcaataagtgatgcttcatatggtaaccaaccatattacaagtcacaaattggcaacatatatttacttaatggaaaggtaattggaggaaagtccaccaaggcttcattaacatgtacttcaactacggaagcagaaatacacgcgataagtgaatctgtcccattattaaataacctcagtcaccttgtgcaagaacttaacaagaaaccaattactaaaggattactaaccgacagtaaatctacaatcagtataattatatccaataatgaagagaaatttagaaacagattttttggtactaaagcaatgagactaagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatttctcaaatctcctatattacgatctattctttagtctaaatgttaccaatcgttatccttttttatcatcaatccgtgcgtttcagttgcttttaaatttgataacgcattcttatcatttatgtcattttattacatcatatatgataatattccgtcaccttgaatactcatcaagaaacgataagttgttgtaatttaacagtaactctgcatataattcaacaggtaaaaactaacttttatatccttgaacttcttcatttttgtgtctttcattgaaagtataattttccttttttttttttggttttcaatacatataatgatgggtgacattttttgtgtcatttagattaaaagaaattttaagaaaaattgacgtatttaattttgatccgcagtaaacgctataaattctttttaatataaatgacagctttttatacatatagaccctttgaagaatattccaaactagaaaggttgatcagaaatgagttatagtgtcaacacgtttacagattacgttttattgtttggatcatctagtttagtaggaaaaggtattttagagaacctgttggacataaatttatatattaaaaatgtttcggacctacaaggcaagcttgatagcttaagtgaaataaagggaaatgtcgttctcaataaacatgtcttttgtgttaatagaaggtgcatcaatgaggagaaatcatttatgaagaccattgattatataaatatgagatcagttacttggcaaggtggcagatattacttgagaagcaggaaagaaaaagacactgaaaaagtaccgtctagtcctaatactttttgttatgataattttgaagaaggatttattaaaaatacgcctgaagagaggggaaaagatggttattcttttgtttataatcagaaacagttcagttacacactacattatgcatgcggaaaggaaaaaggtattgagatcatttgtaattttactgtaacgcaattgatcatccccagatctgaaacttggccaaaattgcttccacggatattctcaggaacacaaaagctggaaaagtttgacattgacaacaaaaattacgttcccggtagaagtttgcctagtctgtgtgatattagcactatggtgtgctctttgggctccacctcagctagagtgcggagaactcaggtaccaagttcctttgctgactattacttaccttttaatttagcacaagaattcacgaatacaactaacaaaaggttggtggttacaactgcctttaataatgattttcttagtaaaactttcgagtattttagaataaaagctaaattagaaaatgacttggatgaagctttgccaaataagctaaaggagctagttattttgaggccaggtccgatgtgtggacagcacggaaatcctataaacgttgaattgggtaaagaaaactccactttcttggaaaaaattttttattatcctcactatcttttagtttataaaaagaaatatatcagtgaggccagaaggattggcttaagaacaaagttaagcgaaataattgcttccagtatatataggatgccaggatctgcattattaggatacgctgtcccagtttcaaaggtttcttatgttgcctctttgatggcgattgaaaggaaaagtaaagaggcgggacctaagctggaagtaattagcagttatcaaattgatatgattgtgtgaacagtcagtcttttcttttgatagatgcgaagttattaaataaatagtagcctaatacataaaagaaccactatatcatggattcgatacctgggccgtcttaaatttttatcgcattgaatatgcaaactttatgtattgttttactaatcgccagtaatggccgaccaattctatgatagatcttccctaagtttataatgatggtaagaaaacgcgcatatttcaaaactgaagaaaaaacaaacaaaagccatatggataatgaggggaaaatgtgatttctttacttgagcaattctttcaaactatcagtaacgctcctggcaatgagtagaatcgatgatttacagcaggacattgaatctttactcagtgaaagtatgtgattttgaggctgtaacaattttctttcttttaaaaaaatgattaagttgaacactaacatagtagaatcttcacagtcaattcattagaagaaagtcgtgagaagctcaaagcgaagataaaagataaaagaaaaaatgaggagagcgctaatcctatagtacaagaatttgaagatctattcgatcaattcccacagttgaataattttttatttaatgagcatccagaattggaagagacagatgacaaggacatatcaagggcgcaagcggatataccagcaacgccaataccgtatgaaccaaagaaaagagctaagctggagaatgaggaaattttaccagaacaagaatgggttttaaagacccagccaatggttcagcatcaaatgtttgatcctggggtggcagatttattggatacagacattctaacgtcaccttcaaaaagaaagcgaaaactaaaaatagacgatattagtacaagtgatagaagtgagttggaagattatattgtcctggaaaatgtttatagaatgtttggtataacatttttccctcttgtggaccctattgaccttaagataaaagatgctagcggtgaaatatttgttgatagagaaatgctgggaatacgactggaagtcttcagcgaacggacatcccaatttgaaaaacctcactatgtattgttgaaaaagaggatcaaatcgaatagttggttcctgttcaagcatacaatcccgagtttcattgatgtccaaggtatatttgatgacaccaatgggggactagtgatatctcatgatgacgcctatttatttgctaaaagagtcttcctgcaacttgtggaagtacagaaaagacgacagatttttaaggacttagaagctaagaagataatccacgacttagatttagatttagaatcttcaatggtttcgttttttgtgaaggatattaaagtcgagttgtttgtaaaacaaaatgaaatagtttcatgttcaatattggacgatattcatgattttagtcaaaataataaaagtaaatgggaaattgcattgctcggttctttggatgatttggaattaaaattaaaccattctttcgcgacaatattcaagtgaatgttaacaaaaatatactttatagaaagaggatagagctaattttctctgtttatcatagatataagtaattgtgtagtatcccaattttgggtagaatgtggtatatgaaaacagggcatatgaaacccataaggcaacctaacactttttccaagatagtatgataataaatagcggtaacccagagaatacatatccaaattactaggacagcgcaaacaatggcaaggcaagctcgtacccacttattcacaacccaaaacatatcttcagcttgaacaaatctactgaataagtgaagttccatccaaagaatcatgcttatactcacaagaaagcagaagtgtccactaatgtcaaacccaccatcccatttcccattttctagacggcacttttcagctgatgtcgttttactaccagaactgcattctccccctgtccaaatgaaaacatgatcgataaattggaaattcaaaaacaataatagatattttagaacgaacttgcaagcatattgagtgatcataatactgattattctatttttgagcagaggccaatggttagtatatgttaaataggaagagctagtttcggtacttgatattggtaaaggcaatatatccattcttgctagatagtggaagtatatttgcagaaaagccaaactaaagaataaaaatggccacagttggttcgctttgtatgcaaaaataacattgaaaatattggacgatttcaatagagcgcatgtctctttttgatggtttaatgtttctgaagatactactattgataataatgcgcctacaaaaacttgaaaggggtaaatgagatacgccttccttgaccaataattgagctgacgtatcataatctttttcaatttttagtcgttcagtggttttaatacaatgccctatttctattgtgttttaacattgtgatattttgaattttttttttttttttgcagattgtttttcatattaatcaaattgggtgccacttgtaagtcaataaatgaaactaagcctttccatactttttcctaacgcgctttgaagaatttgttttcctatatatatttgtataaagtacatatcaaaaacaactgagcgaagcaggcacacaagggaaatcagttaatgtcattctgcagtttgaacttatcccaagcaatacttaaagtactgaaaatattctctgcaatcatcttattttccagggacaaggactctggtatcttatcaggatgtgtcttggctacagctttcatgtatgtaattttgaccctcttaggcataaccaaatcttgcatagagacatccttccaattgcaccatgttagtaagctggataaatttgctaacagatgacgaatgtcatcgtctttgccatccttccaggagctaattttctcaaatactttatcatatagcgccagtttagcgttttctagctcccgtttttttatttctgaagtgctatcaacagaaattggagaatttgaagaagaagcggttaagttctgtttttttgttgcaggcgaggttgtcgttgtcttcttcttaacgggcatggattttttaacagggggaggattaataaagtcttggcatcttctttttccctgcatgattttatcatcaaaaaaattcttcttaatcagctcttggtatgtttctagtgcttttttgaaactttctaaatgttcaaaagactcagcacgcctaatcataatctttggccagatgtcgttaaatgatctttcagggtcactatttgagattttattcttccacttagctttgcttgatgggaataattccaaagccatgctggagttttctatggacttagagtactcaccgattttcagttgcgaggcaataatgtttgataatgcaatgatcctcaatggatgatttaaaggcaatgtatttaaagacttttcatattcttgtaatgagttaatataatccccgttcttgaacaaactagtacctttcgccttaaattcgttataccccgataattcaatatctgagatgggtattgtagagtcagtgttgctgttttcattgaagagggtgctatcttcattgcttttactattggtgagatttccttctgaaaagtcgagaagactatcctctatcaggggctcatttcttcgcgaattttcttcaattagtataccagaagtcggtgaggaggagtgggagacatcaggcgctgtcctctttgttatatcaatctttgtttcgaaatcagttaaaagatcttgatccggattatcggcaggtggtaagttctctacgacttcattatcttcaaacaaaattctattgggtgagtcgtttacttgaggcaaatcataatcctcaaccttatcatgagtttttgagtaattattcagtctatcatttgcctcaggtgggaaggaggtccattggtctaccagtttcttacccttattgaaaaaatcagtggccatgctgaataaattattgctatctgtaccaacaatgttggataatcctgacttttccatttttataccactttctttctttcttatagctagatcgttgcgctccttttgctttgactttaaaatctccaaatatctttcataagttacgtcattttcgtaaaactcagtggcttcttcaattgataaacctagagacatcaatcttgctatttccatatccttaacttcatcaactaaggcgtcatcaccattgtaaaggtggtcttccttgcttccatagtaatcctcatccggtttttggatcgtatccgttgtagttactgtgcccataccaaatagttgattgaagtcgtcatcggtattggcaagagccgagggaggtgtgttgttggcagtattagatttagtggtgctattagttgggaccaaaggaggtgcagaaaaatctaccttcggtgacggtatcagcggaggagctgaaattgaatgcagactatcattggggcttttatccgtccttgcaacatctgcaacagcggaaccagtaatggaaggcgaattgctgctctgaggagttgtttccttggatgcagatgcagagtccttattcttcaaagaagtcagtaaatgtgcaaatggatctgacattgatgttgactgtttcttgcaggctgcgtcctttccagaagcacaggaataggttaagcgatgtgctgttatttttttctccttttcgcaggaaacagtgatcttaaatgaatatattagaaacggtatagcatatatatatgtgtatatgagtatgcgtatatagaaaattggtgaattaaagaggtggcttcttgttattggtcgcttccaggttgaattggacgctactatggtagttatcacaaattgcgcccatgatttctagatttttgttccgattattaatggtcacaagctcctggttaagaattgccacgctctcattgagccttttgacattaccaattattcgcgaaagtatgttagcctgcacttgttcatgagggttctccatgttatgctttctttcctaaactcacttcttttcctccctatctgcttttgtttattacagttgaaggctacttgtgccgttcgtgtgaaaaaatactcgatgaaaaaaaaaaaaaaaagatgatgacgatgactttgttgaagaaatgtgtttgaagacagtggaggataacagcactctcatcgcacttttggaagcgtatcatgaaaagcgattcagttgaaatcactaccatctgcccagatgttgaaaattctcagtttgttgtgcaaagcaactgtccagagactattccagagattctaaagtctcaaaatgccgctgtgaatggcagcggcatcgcttgccaacaacgtagcttaccaagaatcaaaatcttgggtaccggtggtactattgcatcgaaagctatagactcctctcaaactgccggctatcatgttgacctgaccatccaagatctattggatgccattccagatatatccaaggtctgtgacattgaatatgagcaactatgcaacgtggattctaaagacataaacgaggatattctttataaaatttataagggcgtctcagaatcgttgcaggcttttgacggtatagttattacccatgggactgatacgctatctgaaactgcattctttattgaaagtactattgatgctggcgacgttcctattgtttttgttggttcgatgcgtccttcaaccagcgtttctgctgatggccctatgaacctttaccaagcaatttgcattgcttcaaatccaaaatctagaggaagaggtgttcttgtttccttgaatgaccaaatttcctctggttactacattactaagacgaatgcaaatagtttggattcttttaatgttagacaaggctatttaggaaattttgtcaacaatgaaattcactactattatcctcctgtgaaaccgcaaggttgccacaaattcaaactgagagtggacggtaagcattttaaattaccagaggtttgcattttatatgctcaccaagcctttccgccagctatagtcaacttagtggcagataagtatgatggtattgttcttgctaccatgggtgctggttcattgccggaggaggtcaatgaaacctgcatgaaattgagtttgccgatcgtatattccaagagatcgatggatggtatggtgcctattgccaacgtaccaaagaaaggttcaaaggaggataatctcatcgcatctggttatctaagccctgaaaagagcagaatcttgttacaattatgtttggcaggtaactacacgttggaagaaattaaacatgttttcactggcgtctatggtgggtgaaaattttgtaattttttgcatttgtgtcgatatatatatatatatacatagacacagagatagagatataattatgcaagtccctgttaatgctagtctgagatgagtacaggaattcttcatttagattgtctcggctatgtcacttttctatcgtttcacctgcacatggctttgtcttgaatactgaagccgttattatagttctatcttcatgtttttagaggttttttttaaatgagtttattaaaattaaattttgaatgttatttttgaataaaaatataaaaaaaataatattaataatttttcattaactgctcatgatatcagtgcattagaaaatcttttggttccacttttcctataaaaataattcaagttttatcattatatcatttttaaatatttgattatcatcgcccgctggtcaccgcatttttaaagaataaatattacttttttcgaaatctggtgtttaaatatttttaagaaagttaaaaaataaggaatatttgataaacaaaaaaaaattagcctttatatatccatttttgtttatgtattcctttttttattttcttatgtgtttgggatttactgtcgcagtcttttcaaattttccgggctaaaccggaagccggaaggtctgggataagacaacagtatccaatacaatatcagactacagcaaaaagcttattcagagatctttacagaaatcaaggtcactgccgaactatgttacgaagatctattcataccactaaaatcctccaaaaacctaatgctacttcgcatatttggtcggactttaccacaaggcctagttcactttctatccaatcttcaaaagtgaaaaattaccttttccagaagaaagcttctctagacccaccatctatcagcagaagaagtaaccgtatcaaatattcacctccagaacacattgatgagattttcaggatgagttatgattttcttgagcaaagatccagtaagttttatgagttggccaataagactaaaaatcccttgaagaaggatgcacttctcataaaagcagagatcaataatcctgaggtacaatacaattttcagtttaataacaagttgaacaatgttaaggatataatagattatgatgtgccagtgtacagacatttggggaaacaacattgggaatcgtacggccagatgttattgatgcaaaggttagaaacgttggctgccattcctgatactcttccaactctggttccacgggcagaagtgaatatcaaatttcccttctctactggtgtaaataagtggatcgaacctggtgaatttctatcgtccaatgtcacatccatgcgtcccattttcaaaattcaagaatatgaacttgtgaacgttgaaaaacaattgtatacggtactgatagtcaatcctgatgttccagatttgagtaatgactcatttaaaacggctttgtgttacggattggtgaatattaatttgacttataatgacaatttaatagatccaagaaagttccacagttctaatattatcgctgactacttacctccggtacctgaaaagaatgctggaaaacagagattcgttgtttgggtattcagacaacccttaatcgaggataagcaaggtcctaacatgttagagattgaccgaaaggaactaagtagagatgattttgatatcaggcaatttacgaagaaatacaatctaaccgctattggggcacatatctggagaagcgaatgggatgccaaagtcgccgccgtcagagaaaaatatggcctaccacctggaagggtttttagcagagttagaaggtgatcctaaatagtatgacattatagtatcctgtacatataaaataacgtgtcattgttaataaagcttgatgcaaataatataaagtaagaatctgaaaaatttttggaatgtgaattttgtttacaatacgatacgtatgatattagtatgttctagaatatatacatttcatttttttccttattgtttgtgcactaacgaatgaagaaaaaaatatggaacatctagcgaacgagaatccatcataacttcgtcattcagtgcgagctaatgtgcatttttagtatcctatttatgttgaagcttctatttatgttgaagcttccttcagggattcaacggcgttaagaataactctttcaaaatctatattaggatcttccaaattaaatgaggcgttcgcaggcacatctttaggagttactacagggtgtagcttggcgtattccttctttgcctcctctaccagcttcaatttctcctcgtactgtgcctgctcctctttcttcttagcattacacttcaaaatcatatcatttctaaaaccaaaaaatagccccaaacccaacgcagagtatctcaaaacattaactgtcgacatcctttaactcactcagctagttcctatatacgttatgttccgatataatacttccttttatctaaaatttctgtgtgaaaagtcaaaaaaactaaagaaaaatttatacccttaaatagatctgattggctccgcggaccaattagcgtggagattccgcgaatgatcgaataataaagatatgtcttaattaaacccatggtcacccagcttcgattgaacggtatgtattcttgagtgcaattcttctaagttcttattaagtgtgacgatctcctccaatctacgctgcttcttatagtcctgaattgtggactcaataaggtagctttgttcctttaggaccatcaattcttctctcagctctttcacttcttttatggtcaagttttcgatcattagttgcgataatttctttacctctggttcagctttttgcccatcttcattcgttttatggccctctgggttcaaaattgccggaagcgacttcaacggtaggattttttcgtttatgtatgcagcggaagctatcttgatcgaattttgaagttgtctctctagatgactttgaggttctacacttaagagctgtcttgttagtgtattatacaagttaaaagaattgagtaatttatgtcttaatcgagcgagatcattcagattctttggatcaagtgtattttcagaatccttggcagtctccaccttcaggctattcaatgagtcttcaaaaatgggcaggagactatcaattactttggatatattttgcatgctatcatatttagcaaatattccacttagcggcattctaacgtccttgttaaatttcctgccaataaatagcatatcgatacagtgcgagcacaatcttatggatataggaatatgaagtaaatcatccttctgtatattgtattcgaatggcagatctgacgctgcagacattaaataacctatgcttatttcgtttgagcagttcctgtttgcatcatcacaaacaaccataccacataatctgcagtgatgcttccttagtaatagcccaaatggttcggaacatatgttacaaaagagtacacttctatcatctctccatggagtaactgtacgttctaacttggacatttcactattcatcttcaaattatgaataatggatctagaatatgtgttatagagtgtaatcagaccatcaactagacggacaaaccgattttctaattgtaatagccttaagtttttgtcctctctttttatatttcgtaccttaaagaattctggtgttaaatctattacttcgccataatcgttatagccaggttttgtgacgaaacaatcatggcagcaattgtaccatttcccgtttctggggtcatactgtgcggaaagattaagtttaatcatattaggaagatgccttctgcaatacagtttaccacatttcctacaattaatggcgccaatattgttattcaaagtccttccacatgtgtgacagcagctcttcccttttttgaatttttcccaatggcttcttttcaacttttgcgcactgctatcaacagatctggcctttttttgtttaccattgactaaacgactgtcattggaaccgagtgaatcttcattatcgttaaacccatgctcaacatctaaatgtgcatttagtgcttgtaagttatcaaacttccttagacaaatgggacatgaaacattttcaagatccataatagataagtcgccaggaaattcggtgatatccctttaaaaaccatgagatccggctttgctctttaggtcggtcaatttagctactgatcatatgttttcattattctattgttttcccaaagtattaccctgcctggaaataacagtgatagccagagtgattccatcgccagtacttttgtaattcaggaatacatttataccaataaatggctcacatttaatgtctgcatacgtgattactacatatatatgtctgcgtatgtgcttggctattttacattagcgagtttctataaagtactaacgccattagagttttttgtaactgaaaaatgcccttagagtatgatagccttttaatagcatctctctattcttcggtatgttgacttaaattaatcaaaacactaactttggttgaataaacgccttttgtttggagtgaaaagttaatggatttctttcaattattgccaattcattactagaaattaagtcaacaaacagtaaaggtttatatttatcagtaaagaagaagtgaccggagctttcttcgtttctttgtacatctgtggactttattttgtttccttggtttaataatacattcaagttttcgctgatttccatatcaatatcgtcatcttcgtcatcttcctcgtcgttcatgaaattactttcatctgtgatagttagcccttcgtgtgtacgttttttctgttttcttctcttatttatagggaagtcaacatcaaagtctattcttgatatccaagtagccccccaaaaccataatctgctactattttctatgtctgaaaatatccctacacagttctcttttaatgtcttccattcttttggtaagttatccgtattgttttttgaccattgagttaatacgctttcgctatcttcattctcggcttccgaattcaaattcatattgaattcataaatcttattgtctgcagtaattactactacagattttctagaagtattgatatgaacagcggtgatgaaattattcaaacgagcaagtggtttagaaatccttgcttttaagtctaatatgtctacgactccacagccacgagaaattactgcaatgttctggtctacttccaaatggttgatcctgttaatatagggaactttgatactgctcttagttgaagtaacctccaaaagttcaacttcttgcggtttttcatcttcttcagattctagatccacaataaatacatcatcttcgcaagagcatatgacaattttggaattatcgatgaacttgactaattttgtggaagttctcaataataggtcattatctagtttagtcactttcaatttattacctacgggctgtaaatgaaaaactttagtggtagagggcctccctacgactaaaacttgtccatcaggtgataaagaacaagttgagatattctggtcatcttttaaagttaacttgcaaactagcttataattctgttctgtactagaatcggttcccattgtccatatcttaacagtagattcgctccatgaaacaacaaggcgttgctctttgttaactaaaacattctttgaataaggttcgacagttggcatcttcctgtagtttccattagaaaaagaagtaagtgagttgatgactagtgttttttcaacacctcctgaaactagaaaatctgcacctttagattggtatgcacatattgctctaatgtcgtttccatgaagcaacctattagaagaatttacccatctgttgttcttttgagatttgttagtgttttgagaaaattgaaagatttttctgtccacaccagcactaaaaacataattattatcagtatcggtagttagacacagtacgtctgcatcgtgcgccttaaatgactggtttagcgtggcaaactggaaatcccagaatttaatggagcctgtagaatcaccagaggcaatctgatcagttcttggtaaatatataactgaccaaactagagttgattcttttttggccttgtcgaccttcatagtgtgtaatagacgacccatgttttcgtcatttttttgtgcagaccaaatccttattctaccatcagaacaaccaccaatcacgaagtcatcctttttccaagccaaagtcaatactctggcttcttgtctcatcaaaatagtatcgtgttccaagacaccaggcccgccagagatatctatgaggaccaccgtcccattatcgcaacccacagacagcttgtcttgtgaatcgttgatggaaatagaccatatcacacctgaattgcaatcatagtttcttaatggtaaacctgttgctaaatcccattctgttaccacagtcgagccgccaatagaaaatagccttagagactcgccgttaacgttgctccagcaaaggccttcaattgatctgtctttgccaccttcgataaccatttcctgaaaccaattgtttctaggattccagatttctatgttaccattagatctaccaatagctaatctcaaatcggacggagttaacttatttatatttgatttatgtgaaaatgctagagatgtgattgtggcaggagtgaaatccacaaatctgcatctatgcactatcatcctttcctgactggtcatcttcaccggtttgtttcgtattttcaggcttcttgacttttcttttaaaactgaaagtagcgatgagctcattcgtagcttttttcttgtcagtctgaaaatttttcatttggttttttgaaaaaaatcctgcctaatatggtatcaagaggaataacaagaaaaaaaaatcatgggggatacaaaggaaaacaaggagataatgcaggttatactgaattgctcatagtattagcctaaagcactttacctctgatttattgcatctatcgtattcttgagttattgcgacttttaaaatccgtgcaccgcatatgaaagggtagagccttcgtgtttgtttacctttttagctctttgaagatcaaacaaaaacacttcagtaatgcctacagccttggataagacaaagaagttaacagccgcgcccatcatgcaagatcctgatggtattgacattaatacgaaaatctttaactcagttgctgaagtatttcaaaaggcacagggttcttatgcaggacacaggaagcatatagcagttttgaagaaaattcagtcaaaggctgttgagcaaggctatgaagatgcttttaacttttggttcgataaattagttactaagatccttcctctgaaaaagaatgagattatcggagacaggatagtaaagttagtagctgcatttatagcttctttagaaagggagttgatattggccaaaaaacaaaactataagctcacgaatgatgaagaagggatattctcaaggttcgtcgatcagttcataagacatgttttgcgtggtgtggaaagccctgacaagaacgtcagatttagagttttacagttattagccgttataatggataatataggggaaatcgatgaatcacttttcaatttattaatattgtctttaaataagaggatttatgatagagaaccaacggttaggatacaggctgtgttttgtttaactaaatttcaggatgaagagcaaactgaacatttaactgagctttctgataatgaagaaaattttgaagctacgagaactctagttgcttctatccagaacgatccgtcagctgaagtacggagggctgcaatgctgaatttgatcaatgataataatactagaccgtatatcttggagagggctagagatgtaaacatcgttaatagaaggctcgtgtattcgagaattttgaaatcaatgggaagaaagtgtttcgatgatattgagccgcatatttttgatcaattgattgagtggggtttagaagatagggaattatcagtgagaaatgcgtgtaagagactcattgctcatgattggttaaatgctctggatggcgatttgatagaattactagaaaaattggatgtctcaagatcctcagtgtgtgttaaggctatagaagcactttttcaatcaaggccagatatattatctaaaatcaaatttcctgaaagtatttggaaagactttaccgtagaaattgccttcctctttcgggctatttatttgtactgtttggataataatataacagaaatgctggaagaaaactttccagaagcctcaaaattatccgagcatttaaaccattatattcttctcagatatcatcacaacgacatttctaatgactctcagtcgcattttgattataacactttagagtttattattgagcaactatcgattgccgccgaaaggtatgattatagcgatgaggttggaaggagatcgatgcttacagtggtacgaaatatgctggccttaactacactctccgaacctcttattaaaattggtattcgtgtaatgaaaagtctgtccataaatgaaaaagattttgtaacaatggcaatagaaatcattaatgatattagagacgacgatattgaaaaacaagaacaagaagagaaaataaaaagcaagaagattaatcgcagaaatgagacttccgtcgatgaagaggacgaaaacggcacacataatgacgaagttaacgaggatgaagaagacgacaatatttcatccttccattctgctgtagaaaacttagtgcagggaaacggcaacgtatctgagagtgacataataaataatctcccacccgaaaaggaagcgtcctcagcaacaattgttctctgtcttacaaggtcatcatatatgctagaactagttaacacaccgttaacagaaaacattttaattgcgtcgttgatggacactttgatcacaccagcggttagaaataccgcgccaaatattagggagcttggtgtcaagaaccttggtttatgttgtctcttggatgtgaagttggctattgataacatgtacatcttaggtatgtgcgtttcgaaaggtaatgcatcattaaagtatattgcgttacaagtcattgtagatattttttccgtacatgggaacactgtggtagacggagaaggcaaagttgactcaatctcgttgcacaaaatattttacaaggttttaaagaataacggtttaccggaatgtcaggtgatagcagcggagggtttatgcaaactatttttggcagacgtgttcactgatgatgatttgtttgaaacgttggttttgtcatatttttcgccgataaattcctcaaacgaagcgctggtacaggcatttgccttctgcattccagtctattgtttttcacatcctgctcatcaacaacgtatgtctaggacggctgcggacatactcttaagactatgtgttctttgggacgatttacagagctctgtaatacctgaggtagaccgtgaagctatgctaaagcctaacataatatttcaacagttgctattttggactgatccacgtaacttagttaaccagacaggttcaacaaaaaaagatacagtgcagcttacattcttgatcgatgtgctcaaaatatacgctcaaattgagaagaaagaaataaagaagatgatcatcactaatataaacgctatatttctttcttctgaacaagattattctactttgaaagaacttcttgagtattctgacgatattgcagaaaatgataatttagacaatgttagcaaaaatgctctggacaagctaaggaataatttgaattcgctgattgaagagatcaatgaaaggtcagaaactcagacaaaagatgagaacaacactgcgaatgaccaatactcgtctattttggggaattcattcaataaatcttcaaatgacaccatagaacacgctgctgatataactgatggaaataacacagaattgactaaaacaactgttaatatttcggcagttgacaatacaacagagcaaagtaactcaaggaaaagaacgagatcagaagcggagcaaattgacacatccaaaaacctggaaaacatgagtattcaagacacgtcaactgtagcaaaaaatgtaagttttgttttacctgacgagaaatcagatgcaatgtccatagatgaagaagataaggattcagagtctttcagcgaggtctgttaaaattgatatgcgagctcttcatctatttaagttgattttttggttgtaaacatatttgtattttattcttaggtttgttaattcttctacgcttaccagatatagatgctatatgttattgcattacgcacattacccggtgggacaaattatggaaatattccaaggctataaattctttggtgaaaggaactgaaattatgtccagtaatgcaccagaaatggacatataaaactattaatgcattttattacaattatcctaagaaaatatcctatatataattaaagtaaaagaaataagatcaaaagaacaaaataaagtcgagtagaattttcctacttgactatattagaacgaaaaatgttattttatcaaagtaattggttagtagccgacgtgttatccgtttgggccaataattctttcatttcttgcagctgcaattcggtgatttttatagattcaactagctgctgtattttatgatcactaactccatttacgagcttaaccttcttgttattactctccttaatatgattggacaagacactattttgaacggttccatttccacgatctatcaaccagtcccatatgagaccctccgtatcggtgactatgttatttttattcgagtctttacggcgggcatcttttataatattatcttcgtaaacatgatagagtgttttaaaattaggaacgtaattatattcatttccattaattaagattgttcctggagtaataatctggatgttcgaagtattcttagaatggaataataatctaaagaagaaaatcaagcaaataaaaaaagagataattgtcataattccttgaacggatgttatgtttacttgttgtaacattgagaaagcggaaaaaaatgaatttttggtacttgtatcttcgaagttttcttcattcttctcattcttgatagtggatggtgatgatttccttttatttaccgtctttcctcttctcctcgattttttcttcgttgaactagcattagaaattatttttttgagatcatctacgagttgctttgttgaacttctttgtccatcaattgaacctttctcaatggttcctttcagcattgatttacctgtccagacaacattggtgacaactttcatgttcgttgtgttgtgatcaccccaggaatagaaaaatctcgtatgtactgaaaatgaactaccgtaaggaacatccggagatctgactatttgttttaccataaaaaaactgttcaaatccatatgctcgatggtctctgtgactatacatttagtttgcttcggaccgaatgaattgttcaattttttggtataggtgatctctcttgcgttattcacaaactttggaatatcacaaacattaaagttattctggttttcgatgattttcttaatatatgatgtgtcatcaccatacaatagtgaaaacactgttcctaaaggaactggtatattaattttttcatcgataactgtatcgtcttttcctttttgaaaatcaggttccgtcggatcatgaactggaggtccaatagttggcagattaataatttcttcttctgattcattattgctggcttgatgctttgagtttatgtttgagtcttcatcacttaagattttcttaatttcagatatcattatctttgtggtgtccgcaacaccatcaaatgttcccttttcaatcatacttttgatccaacttttaccagtccaatcaacagaattgtaaactgttaatttggtggagttgtttttatcccaagagaaaaggaaaacagttttcactgaaaagatattccctgaaggaacatccgggttcttggtaatactgagcactttaacatagtcttccaaatcataatgctctaaagtatctgtgatcaaacattttgttttacttggaccaatgctgcctgataacggtttcgtatatgcatagtcacgaattttctttgtgaggaaattgttagggattggcgatatttcaaaatttttctgagctttaaggatcctttcatagtaagagacgtcttcaccgtataaaagatttactacttttcctaatggtgcattaatatttgcttcaataaccaaatgatcattattggaaggtttgaaatcagcagtggttggagagtgtttattgggacccaataagtagttcgtagatttttggtttttaccaagatcatttgattcattgaaaacatcagcatcaatatcgtcactagatgtcatatctgtgctattaatatcagggtcatcgtcatccaggtctccatcgtcgtcattgtcatcggaatcatcaaaaaatgcactgctcgaatcgcttatcgtaccgtcgtcattattaccgaagccattcctatattttttacctaagatgatctgattccatacatctgtaattaaatcaaaggtagcatcccttgacataaaagaggcgaagatgtactttgtatgcaacgtatcaattacaataccattggggaaaattccggcggtagtctttttctcaatctgaacgatttccttaaacggaatgaaaactgtactgacccatcccaaaatgtttgagaaaaatccaatgtgtgcatcagatatatacatccttccttgtaaaagaatatcacgagatagtgcacaactatgatcgacaattaacttttcgttaggattaatatcgcagtccttgaaaagggtatgaaattcgctgtttttcttttctgaagcatattcaataccttctaacttgaaatcatcattgccagaatccaaacccattattgcatggatattacctgagcccgcagtacttgttcttggcatttgctgtccctgatttgtactaaagaaatcagaactactattcctatttttgttgaatgaatttcttaaattaattccagggatcactttattgcctaagttcgaaggtgaaaaagatctcctgtttaagaattttttggacatacttctgaattttctttcgtcggcatcatcaaaggccatatcgtttgaataagaagaatatcttgaatttcttttactattaccttcatcaccaacggcattctctaatgctttgttcgcgggcagtgtcttacttcttgccctatggctagaaaggttcgattgtgaattttcaaaccttgccatgtcgatataggtactattacgataacttgtgtttaattcttttggaccgagattattgtttacgttacttttgctaatatgactcaagtttgttgaacttgcatttggattattattggtattattctcgtccagatcaatagttgtattatcaatatcagaggatcctgccactgcctctaaagttaagttgcctttaccaaaggttgagattgcaggctcgtgtactttcaagggctgaaatttcactttgccaacatttgatctatcatccctatcattgtcgttctcggtttcagagttagagtttgcatttacgtttctattgttaggtgtcaaagaacctgaaaggggcgtagtcgatgtatttgtaggtaccagttgagttgatggtgaaagaaatgctttggaaagaggcgataactcttcctcgtcatccccttcctctacttgagtatgtttatcagaggctggaccagaagtgggggatagtaaataatctaaatgacgcaaaaatgatgaactgcggtgggctgtgttagcggagggggaatgaatgagcactgtgtcattgggattttggttagcattttcggaaacaggtaagggcccttgttgctgtgacaagggatgttgctgctgcgcgtggtggatatggaaataaggatggcgagttgaacctgtatgactttcacctgaatgcgaaaattcacgttgtatctcagtatttaaggctgaaattttagggacatgagatatggcactatgagcaattgatagaatagtatcaaatagactgtttgaagaattctcaatgtcgttattgttgttaatattattgggtgctgacattgaatcgatagctgggtgcgaagaactttgagagtcatccttctgtaagatgctcaaaactggtcgttcattctcagaagacgaagaattgaatgtatttttagtatcagtatgtttgactttctcacttgctctatctatagtcactggaatattaaaataaccttgtggagaagtattcggtttcttcaagccagccttagaattttgtagcgatcttcgaggtatgaaagtcaagtctataccatgtttgttcttattactcttattactaatatgacttctactactccttattgagacgatatctggtagctctaaaggcagtggtgggatagaatcactaaaatgaggagtatgagaatattgagcaggagagtttgaaccagagttaccggcaacaccttcattagtagagcctatgtcggtcagtactcttctcttagcgatggtctttctgccattgttggcccttcttaatgatagggatgattttgctgcggaattggtagattccttccttgtacgagtggtcttacttctttccataacaggttgctttttccttgacatcaatttcagtttcttgaaaaaatgaccatcactaaatgacctttttttgcgagtagcttcatccctcattggttagggatatctgtacagctgctgcttctatatatttatatgtgattagcaatcaatataccctattttagatgaataatttaaagcaaagggttaagctggtgttgaaatgctcgaagaaaataaacttgacttaaaatttagaccaaatatttcacaaatatgattcaaaacggagtgtttacagctatctgtcctaaatttatcccgtctcatcatgtaaacaatagcttttataactcaataattttccttttttcttcttgtcacttttgcggcttttagaagacgcctatcgctacacacgacgatggaccacacatcttattgtagtttgaagtttatgtaaactgtatacatatataattcatacatgcttggttatggtggactaacgtacacattgcatgacagcaagccttgtttgcttatttttgcctatcttgctctgaaatggcgcattatcatcggaagaaaggatcacagtcatcagaggaaatgtaggctaacggtcttcagcccattcattttcacgcctaatggcagcctcctcctctggagtgaagtcgttgacgatattaaacgttcttctaatttcctcgggagaccttcccctgatcatttcagcaaccaccttgcagccagcgtcaagcaagggcttgatgttgaggtagtttgccgccagaataatttcgtatagcatctcttggtccactttcaggaattctctgtcccatgagtccacgggagcactctttctggaatcgtcgtcatcttcgtcagggaagttagagtctctgtggtgctcggcccattcgataaccttctgcaaaacggaagaccgaacattgggcacgggcatcacaatctcgtcgtcatcctcatcgtcgtcgtcaccgttattgttgtctttgcttttgtggttcgtttccgagtctgaatctgattctgaatctgagttgttttgtaggttgctgtcatgcatatcgttcagatagtttttcaatagcagggatctctccgcgattttcttgtctacggtgaatcgttcaccctcaccactcactaggacaacattagaagtcaccatatctgcgctacgtttgttagtattcctgtattgtttataacgtcttttctgttatatctttgccaacgttgggctatcactttctctgccctcaatatatcaacctatttcttccctttctcttcttttctccaagacgcccgttaaatcgctgcagggtaatgtcatgttacctattgcacacttactgtattaaagattacgctatatatatatatattctggtgtgagtgtcagtacttattcagagattaaggcttgaaggaaaacgagctggagacgccaaagttgctgtatacgctggcgctcagatcatcgagcggctgcacagaatccagagtggccaggtattcgttcacgctgccgctatgggaagacccggcagttgtttgaagcatttcttggcaacagtctttcatcgacatagcgaaaactgccatttgatactgttgctgatcttcttggccaggttttttcttggctattgtctttatgccgaccttgttcattatgaaatggaatgattcatttattagagactctaacactatggatgttgctgtgctttcgatacattgggtcagttcattcaccaattgattaaaaactagtgtgttagagtgaaaacttgttaaagcatccgcgtcaagcgtctgtgacagaagaaactcctgtccactggaatctttaggaagcaaaatagacgtgaggttattattattttgctggaatatttgggaattcgtgttccggaatatgttcgtgagacgagaactaaattcttctaacgttagagtatctcttgggtgtatgccgtcaaattcaatttcgatttgatttgtaattatttcattgtaactcaaccaccccttgttaagaatccaccatgatagtgataggaaagcttgctcattaatatacacttcctggccttctttctttgacttttttgctgccattaccattgcatcatccgctttgtcctccggatcgctccaccacgatgtaacccagttatagaacctattctgtagtttgttgcagttttcctgctgcatggttaattttattgcggagtccaggtactcgtttcttgtcaggatatttagttgcagtcttgttaaaagaatcagcgacgatactgtgtacgtcactgtcaccagcttgatcaaactctttagttctaactcgttccacaactcagctttactttttaacggcgaactttctctgctttcactagactttgctctagtcaactggttcttttggtcctttaattgggtaacgatgctgtccaaattcaaatcgttttcattcaaaaccattctccatacaggaagtagctcgtatattgtgtacaacgagtcttcctgtgtctgctcgaaccttcttttgatctgttctttgatgaagtgttgctcagtaatccgtaactgctgtttatacaaccatctcttcacgaaaaacactaccaccgaccctgtggtaaataaagcagctattccagtcaatgaaatgagtacctttcctcgatgtctctgcagaagcgaacgtgatctttgatttggggccatccttttagtggtttgcctccttgtttcgtgcttctgcttttacgatgactagtattaactacctcaataatataccccatgctcatataagtcgaataacgcccttatcattacacacgattaccaaaatgcaaggaatttttaaggaaaaagggaaatattcatacattcacgcaaactctactacttgttaacgacatcttagctatgatcgctcaatagtgtcactacaaacgcatagactacgacgtgtggcaataataacataccttttatatgtcagagggaaaagtagacgaatttatggccatcactggcgctgatgacgctgctattgccactcaattcatcgaaatggcagacgggaacttgaacacagccatatcattgtttttcgaaaatggtggggctgctttactgagcagtaacaacacacctactccgtctaattcgactcctatggcgcccacctctgtagattcagatgccgatgcacaattagcggagaggttgcaaagggaagcttaccaacaacaacagcctgaccaagattatgtcaggccacctgatgaggcaagacatgaagtacttactgaaacttcaggattcccaatttcttacggcggcattggcggaagatttgaaccattgcatagggtgaacgacatgtttgacgaaggaagacctgaaagcatttttaatcaacgattggatgacacaaatactaatacatacatcaatgacaactcttcagattccttggactccgaggaagaaaatgacgacgacgaatatgagtatgtggaagagccggtcatcgaacttgatgaagacggcaatatcaaggagtacaccaaattagtgagaaagcctaaaaccatttccaaggagcagaaattagctttgttatttaggcctccattttcaatcatgtccaaactcgacttagacgctgcaaagcaaaaggcaagggcaaagcaaaaatggataatgattaacattcaggattcaggaatcttccaatgccaagccctcaacagggatttgtggtcgtccagaccggtaaaaactataatcaaagagaacttcgttttcctacagtatcaatatgaatcacgtaatgcccaaccctatcttcagttctatcacttgaataataaggatgatttgccccatatcgcgatactggatccaattaccggtgaacgtgtcaagcaatggaatagggttgttcccattccagagcaattcatctcagaaatcaacgagtttttggcctcattttcgctagatccaaaggtccctaatcccacggttaatgaacctcttcctaaagtggatccaacaactttgaccgaagagcaacaaatggaattagccattaaagagtcattaaataataactcgagcaaatcaaaccaagaagaagtgccgagtactggcgaagaacagaaacgagtacaagaaccggatccattcagtaccattgaagccagggtgcatccagaaccgccaaataaaccagggatcactacaagaattcaaattcgtaccggtgatggctccagactagttcgtagattcaatgctctggaagacactgtgcgtactatttacgaggttatcaagacagaaatggatggttttgccgattcaagattcacactaaatgatcaccaaagagaggacttgattgataaattaaacatgaccatagcggacgccggcttaaaaaatagttctttactacttgagaagcttgaccctgaaatagaataaacaaattgtatggtggcaggtacctagatgtaattaggtatgtaagcacttataacacgacggaaatacccggatattgtatttttatttttttcccattagcacgccaaacataagaaaaaacgcatacaaagacgtaaaggaatagttcataggtgtaaatacaaaatatatatcacatttaagcatagcaaattgcaaaagccgaacaaaatgcgtatagcgatgcatctgccgctgttgcttttatacatattcttactacccctttcaggtgcaaataacacagatgctgcacacgaagttatagcaacgaacacaaataattgggccgtattagtatccacgtcgcggttctggttcaattacaggcacatggctaatgtccttagtatgtataggactgtaaagaggttaggtataccggattcacaaataatattgatgctgagtgatgatgtggcctgcaattcaaggaatctatttcctggaagtgtttttaacaataaggatcacgctattgacctttacggagactctgtagaggttgactacagaggttacgaagttaccgtggaaaactttataaggctgttaacggatagatggacagaagaccatcctaaatctaaacggttgttgacggatgaaaattcaaatatattcatctatatgacaggacatggtggcgatgattttttaaagttccaagatgctgaagagattgcttctgaagatattgcagatgcattccagcaaatgtacgaaaagaaaagatacaatgaaatcttctttatgatagatacatgtcaggcaaacacaatgtattccaagttttattctccaaatattctggctgtaggctctagtgaaatggatgaaagctcgtactcgcatcactcggacgtagaaataggggttgctgttattgatagattcacctattactgtttggatttcctagaacaaatcgataaaaattccacgttaactttgcaggacctcttcgattcattcaccttcgaaaagattcactctcatgtgggtgtcaggactgatctgtttgataggaatccgtcagaagtattgattactgatttttttgcgaatgtgcaaaacgtaattcctgatgattcaaaacctctttccgtaagtcattatcatcattacaaagatcatatcgatactgctcagtatgagcttaacaataatgtgctggatttggccttggagacttaccgcaaaaacaatcaatcctccaagattgaaaaaaaaatcaaagacatcaagtctactagtgtattggatgttgatatagattccaacgaatgtttcttcacctccttcaaacaatcagctaccataatactggcgcttatagtaactattctgtggttcatgctgagaggaaacactgctaaagcaacctatgacctgtacactaattaaaacacttttatccattttttttcgtataagcatattttacatctttatatatatttattttttttttttttattttggtagaatagattacatatacaactttttcataatgtcaaactatagagttttatttcacataacggaagaagcctattggagccatgagtataataaaatatgacctcaacactagccactagactctcgacatattctatttcattaatactgcagcgcatcaaaattataaaacgttgttactcagctcccgtactcagagattaccaacaagatgctatagatgcatgtgtgaattctattcgacagggcaccaagagaattggtgtatcattagccactggtggtggtaagacagtgatattctcaaatcttatcaatcaattgcgccaaaactattttaaagaacgtcaaggaaattttaaatcgttgatcctggttcacaggagggagctggccttacaagcgacggccactcttaaaaaaatattccccgacttaaaggttcacatagaaatgggaaaatatgattgcgatattgaagattctgacgtgattgttgcatctgttcagacgttgattagaagactccataaatatgatactaattcagtgaatctcatcatcattgatgaagcacatcattctgtggctaattcttatagaagtatcttagatcatttcaaagcttcaactgcagaaaccaaaatccctgttattggctttagtgcgactttcgaaagagcagataaaagagctttgtcaatggtaatggataaaattgtgtaccaccggggaatactggaaatgatcgatgacaagtggctatgtgaggcaaaattcacgtcagtcaaaattgaagcagacttatcagatgtaaaaagcactgcagatgacttccagctggcaccgttatcgtctctaatgaatacgaaagaaattaatgaagtaattctgaaaacttaccttcataaaaagcaagagaaatcactaaaatcaacattactgtttggcgttgataaagcccatgtacaaagtttgcataaattatttaaagacaacggtattaatacggactatgtcacctcggatacaaaacagatagaacgagataatataattcaaaaattcaaaaatggggaaactgaagtactcatgaactgtggaatattcacagaaggaacggacatgccaaatattgattgtatactactgtgtaggcccacaaaatcgcgttcacttttgattcaaatgattggaagaggtttacggttacaccattcgaaagaccactgtcatatcatcgacttcattggagcttctagtgttggagtggtttcagcgcccactctactgggtataaggagtgatgatatcgaatttgatgatgctacagttgaagatttaaaagcaatccaaggagagataatagctaaacaacaaaaaatcgacgaaaggttaagggctttatttcagactgatgaagcagcaatggaaaatgtaactgaaagaaatagcgttgccgattggattcacagtgcaaattcggttgatttaaccttgtgctcctttgatagttttaggaattttacacagagcaataactcatatccatctggcaaggagtttgatgaagcttctgaagctgtaaaagaaatggagctgttgatgaactcacaatatccgtgggtgaaatttgcctcaaatgcgtggggcctccctttaaaaggtaagaatcatttgagaatatacaaagaaaaatccgaagacaaattgtcgatggtatatcatctaaaaatgtatcgacaattaccgtgttttataacaaataaatacgcggactatgttccaaaaagtataataaaagacgctaatctttggaatgtaatgtcaaaggtggaaaaaatcataaatactctaaattcggacttggaaggacaaacaatgcaataccaggcaatatctagtaaatactcgaaatggagacaaacagttcctacgtcaaaacaaagagactttgttttcagaaagctaaagaaagtatatggtgagtcctcaaaagattttattagattatctttggatgatgttactacttatgtaaatactaagatgacgaaaggagatgcttccaacttaatctttgccagcagtttggcacctgtctacccgttgaaatcattgttacgaatattagaatatcaaaaaagaagatcttttataaagtgaaatccgtagctacataaatgtgcatatattaatatacagtcactagtacatatgtaaacgtcggaccactcgtatatgcattttcttttggatcacaccctttctgaactatgcaatgaataacgttaaattcaaataagtgctttagccttactctgcgtactagaaaatgagctgcaacatttcttattaaccctcattttcatttgactcttcattttcatgaatgtactgttgcaaagatatttgtctaatttgattcaacaggtcctcatcttgcattctttctgcctgaaggacagctaaatccttttcattaataaaggttttgatgttttcaaccacttcgattgattcttttgacgtaggcattggtggtaatacgtcaaactcatatacttcattatcagaccagataaatgatggaattgcagccattacagaagactcctcagatagtatggcgaatcttaataagttaattgggattcccgcaataaagaaaggtgattgcaagttgttaatgttattgtgatcttgcccatcatttgaatcgattgtaacgtttcctctatggtaatcctgtaaaatactcgacatttcatcatgcaaaaatgttacctcttcgtttctattccaaagtaacgggaagcgggccatatatgcctttaattccaagttttctgccgaatggccatcaatggataaatctttagttagcgcatgatcgcccaagagtttctccttgaaaagttctgacagttgtaaaggatgatgcttaaaggcttttagaagcgcattgcgggcggaactcatctcatttattcttaggaagcttagtactaccgccaaggaaaatcctaaagtattccactgtttataacagttcattaatggagagttggataattctataatgtactgatagtcattattcaatagaaaatagtgatcgaggaaatacctgcatcctaaaggatcttccaatgggctcagtgaccagagaacttttgtccattcactagcagttcctataacacctctttgagcaagagattggatgtatctaaatattgccaagtaaaactgtctgttgaagaagtatatataaggtagttgacaattcaaggaatcgaaaataatatttgctttcaaagctctatcaaagacaaagagtgctctttgtaacaatccattagtgtttgatctatcaccttgcctaataaatatcaaagcaacttgtagcagtccaggcacatgatacggaaatttagaagaaatcaaatttataagggcttcatgatcagggtgaacaataacacttaagtagaagtccatcattgatttcttgctcaggtcggaatttaaaggttcgaacttataaaaagaaatgaatttttgccactgactgacatcgttttggataacatccttccaatctaacggcctttcccataattgccaatctaaaagatcatcagaacttaaaagtttcatagagagctcacctctttgagttgggatccaatcatctctgatcttggtaaacttcaaatgttgcgggtgcattccggggccattaggtgccaatctatgatcttttccgccccagtttctaattaatcttttcagtctctgaatctgtttcagctgctgaggggagacaggtgtggatgtcatcgaatcaatatcttcaagagactctggagatatatcgtcaaataaaagtttgaattccgtatgggggtccaatttcttgaaatcattttgaaaaaatttgcaagaatgcctcaaacatgaaatggggaactttgtgaagcccggatcactttctaagcttaaaaatgacttccaaggttggctagatgcttcctctggttcagatgccgtgaagaaaccttcctcattagtgtcatcatttttagtcttaccgtacttcaatatatcagtttttttgaactgttggataatcttgtcgaattcttcatcatcatcatcatcatcggaacccttgtcttttgcagcctcggcggtatggtttttttgcttcctttttgcctttttattctttttccttctagaagacttggatgctagtgtaattcttttaggttgaccattactttgagtatcacgctccccagcagcagcagcttcttcatcctgctcagacatttgtccttcatcagtgctattatctgaatcacgtacgttattcatcatagagaagatgttctcccgtttctgaatattaccggcagtacttttaccactcgtcattttattcgcatttgaattcgatagcagcgactctagcagagcattatcatcttgtaatctccttaatgctctagagctcatgttcgagtactttacaaatatatttagatgattcaacgacctgtatgttaaccttcaactggtggactgtatgtactacctatggacatttttcactatacgttgatgcagtagtgaacatattgctcgcataatgttacccgtttatacctctatacgattattaagggagggtaatactttctcaattttttttttttcagtttttaatattatttccttaagatttttcggtggcgtttcgcgacaacttacgagaaaaaaaaaaaagaggagacttgaagaaagagtgcaaagggatagcgggattctaaagtgtttacgtgcaaaaaggatagattttgagctttaaactagataagacccaaagcattcgattactgcatttgagaggtattcaacaataccattttaactcttagaaaatatttccttaagctgaaaatttatgaattctaactgctctttgcattttccaagttattgcattacaagaatatatgaccacatctcgtaaatcgcatgcgaaagacaaaaaggctggtggtgaacaggatctggcggatttgaagtttaggtatgatcttctgacgaatgaactgttccatttaagagagtttgtttcattggtagattatgatccaacccattttaatgattctgaaagttttcagaagtttctcagggaaacacacttgtcgttagaggagagaggagaaaaattcactgatgacgtagccaagaaaggcacgaatggtgatcttactcgcagaaggcgaaacctcaggacatcgacagttgttagttcagaaacgactaatgagaaaaagggtgatatagaactgaagttagaaagcatagcaccattagtacgaaataaatgtgaggagctaaaatacaaactaagtgatcattcaaataggaaatctatagtaccgcaaaaaagaccaatacaacatttgaagaagagagaagcagcgaagtccttgaagttcaaaagtgaaagaaaggaaaatccactgccattgcatgaacatatagctgaagagagatatgatcacatcgcaaaagttgaagaaccctctgaagccttcactataaagtgtccttctgatgatagctcctttgaaaatactagtgaacattatagtgataatttttatttcaccacatcatccgaagaggaagatataaagaaaaaaagaggtagaaagaaaaagaagcctagaataaaactggtagtccatcctccaaagcaaaccataacgaacccgttgcatgtagtcaagccgggatacgaaagcttgcacgaatacatcgcttcctttaagtcattagaagacgatttaacgctggaagaatataataaatacatcgacgaacaaagacggcttttatcgagactcaaaaaaggtattgaaaatggcgcattgaagtatgacaaagaaacggactcactacaacctataacatccaaggaaatcaagactatcataacatataaaccagacccgatttcatatttctataaacaacaagatctgcaaatccataccgatcacttaattaaccaaggtattcatatgagtaagctgtttagaagttcaacaaaggcaagaatagcaagagccaaaaaggtttctcaaatgatagaacaacattttaaacacgtagccggagcagaagaaagaaaggcaaaggaggaggagaggcacaaaaagtcgctagccaggttcgcagttcaagctgttaaaaaaagatggaatatggctgagaaggcttataggattttgagaaaagatgaagaagaacagttaaaaaggattgaaggtaagcaacacctttctaaaatgttggagaaaagtacacaattgttggaagctcagctaaaccaagtaaatgacgatgggagaagcagtaccccgtcttctgactcaaacgatgtattgagtgaaagtgacgatgatatggatgacgaattatcaacatcttccgatgaagacgaagaggtcgatgctgatgtggggctagaaaatagtccagcatcgacggaagctactccaacagacgaatcattaaatctgatacaattgaaagaaaaatacgggcattttaatggttcatcgacagtatatgactcaagaaataaagatgagaagtttccgacattggataaacatgaaagttcaagtagtgaaagttctgtaatgactggagaggagtcctccatatattcatcctctgaaaatgaaagtcaaaacgaaaatgatcgagaatcggacgacaagactccatctgtgggtttaagtgcattatttggtaaaggtgaggaatcggatggggatttagaccttgacgatagtgaagattttacggttaatagctcatctgtagaaggtgaagaacttgaaaaagaccaagttgacaattcagctgctacatttgaaagagcaggtgattttgttcacactcaaaatgaaaatagggacgatataaaagatgtcgaggaagatgctgaaacaaaagtacaagaagaacagttatcagtggtggatgtacctgtgccatctttattaagaggaaacttaagaacgtaccagaaacaaggtttgaattggttagcctctctttataacaatcacacaaatggtatcctggcagacgagatggggttaggtaaaactattcagacaatttctctgctagcatatttagcttgtgaaaaggaaaactgggggccacatcttattgttgttcctacatcagttctgttgaactgggagatggaattcaaaaggttcgcgcctgggtttaaggttttaacatattatggttctccccagcaacgtaaagaaaaaaggaaaggttggaataagcctgatgctttccatgtttgtattgtttcttaccaacttgtagttcaagatcaacattcctttaagagaaagagatggcaatatatggtgctggatgaagcacacaatatcaaaaacttcagatctacaagatggcaggctctattgaatttcaacacacaaagaaggcttctgttgactggtacacctttacagaataaccttgctgagctgtggtcattattatatttcttaatgccccagactgttattgacgggaaaaaggtttctggatttgctgatcttgatgcatttcaacaatggtttggacgccctgtcgataaaattattgaaacgggtcagaattttggacaggacaaggaaacgaagaagacagttgccaagttgcatcaagttttacgtccatacctcttaagaaggttaaaggccgatgttgagaaacaaatgccagcgaagtatgagcatattgtttattgtaagctatctaaaagacaaaggttcttatatgatgattttatgtctagagctcaaacgaaagcaacactagccagtggaaattttatgtcaattgtcaactgtttgatgcaattgagaaaggtgtgtaaccatcccaatttatttgaagtgaggccaatattaacatcatttgtccttgaacattgtgtagcttccgactacaaggatgtagaaaggactctgcttaaattgttcaaaaaaaacaatcaagttaaccgggttgacttggatttcttgaacttggtgtttacgcttaatgacaaagatttaacttcttatcatgccgaggaaatctcaaaactgacgtgtgtaaaaaacttcgttgaagaagtcaataaattgagggaaaccaataaacagcttcaggaggagtttggagaggcgtcttttttaaattttcaagatgcaaatcaatatttcaagtattctaataagcagaaacttgaagggacagttgacatgctaaactttctaaagatggtaaataaacttagatgcgacagaagacccatattcggaaagaaccttattgacctattaacgaaagatagaagggttaaatatgataaatcaagcattattgataatgaactaataaaacccttgcaaaccagggtattggataatagaaagatcatagatacctttgcagtgttaaccccaagtgccgtctcactagatatgagaaagttggcattgggattaaatgatgacagttcggtaggcgaaaacacaaggctaaaggtaatgcagaactgttttgaagtatccaacccattacaccaactgcaaaccaaattaacaatcgcattcccggacaaatcgctgcttcaatacgattgtggtaaattgcagaagttagcaattttattacagcagctgaaggacaatggacatagggcacttatcttcacacaaatgacaaaagttttggacgttctggaacagtttttaaactatcatggttatttgtatatgagactagatggtgccacaaagatcgaagaccgtcaaatcctaacagagagattcaacactgactcaagaataacggtatttatcctatcaagtagatcaggagggctaggtatcaatctgactggggcagatacagttattttttacgattcagattggaatccagccatggacaaacagtgtcaagatagatgtcacagaattggacagactcgagatgtgcatatttacagatttgtcagcgaacataccatagaaagcaatatcttaaaaaaagccaaccaaaaaagacaattggataatgttgttattcaagagggtgacttcacaacagattatttcagcaaactttcggtgagagatttattgggatccgaattgcccgaaaatgcttcaggtggagataaaccactaatagcagatgcagatgtggcagccaaagatcccagacaactggaaagacttcttgcgcaagcggaagatgaggatgatgttaaagctgcaaacttagccatgagagaagtcgaaattgacaatgacgatttcgacgaaagcacagaaaaaaaagcagctaatgaagaggaagaaaatcatgctgaacttgatgagtatgagggcactgcccatgttgacgagtacatgatcaggtttattgccaacggttattattattgaaggaccaggttctactcttcaccgctgccttagttgtccaaatcggactatatacctattgtgaatattttaatgatatatagccataatgaatcaacaaattgtattattatttccgacaacactatcgcctcttggtttttatggtaatgtactcaccatggcattgttccttggtcaccaatttctatttaccgggtgatggcggcgcgccacagcggagggcattgccacattgctgcgcgatcaaggttggtttttccaaagagacttcaagagtactaagcttttgatgtagtaatatttgtcaaagagttttaagagcaagattccattgaacagaggtgctggagtgacgagcgtgtgtgtttttagcctatctttattcgttgagcctgtagaagagccgttcttttaagtacaccctgattagatccccctatttgttgcaaccgttcaagttttgtagatcggaagaagagcaaaacagaaaaataaacaaggcgagaacgtaaggtgtcattgcattagccattaaaaaccatattcactctttacattcgtgtagcaattgttactgtgataaactattgaaattatttatagtatattttgttttcttccttttaatcactttttgaatttttagaatctgaaattttttttctaacgttgattggaagaaaagtaatggattccacaggcgcttctcagattgttagcgcactagatgttatttactcccccaagtctaacaattctcaacggcaagaagctcagaaatttttagatgaagtgaaattatgctcagaatcgcccttttggggctacgaaattgcattgcaaaaccccactaattctatattgaaatactttggactaggattactagaccatgcagtgaagaaaaactggaatgattatgacgaggggaaaagagtggccctgagaaaatgggtcatggaacttaattttggggtgcaagattatgataccagatatattaaggaaaaattagccactttatgggtagaggtggcaaaaagaacatggggtgaggctcttaagcagacaaaccctacggaagaacagttactcacatcttgggtggacatggacaataaccttttcgaactttggaacataaatcaatcgtcaagagaactagcattaataattttcagaatcctttttgaagatgttttcttgttggacgacctaattgttttgaaaaggatgacggttattcaacccttatgtgtaatgattgtttgccctattgaagttttcgcaataaaatacaaattcagtgataaatggaccaaatttaaagctaatgaagagggctggttttctgtttggattccagagttgaataatgcattacaacagaataattctgaatacatcataaggcttttagaaactctgaagacgtgtttaaactggccattaacagaggtcattgtaagaaatgacgtgttatcctccttattgacttgtttatccagcaatatcccaagggcgcagtcaatggcattagactcgatacatattctgttgacccgtccctatagtaatgaaagccattaccaaatgaccatagatcgagtttttgataatatggacttattagatagcgtttatgaaagcttgttgtttgatcctacagatgatatagatgaaacgaaatatcctataattaaaaagttcgtggatatgatcagttgtctctatgtttgtgtcccaaagattaaggagacaaatggccaaattcaaaaatattttaagcttgtattaaagacaacttataacccaagcttaatcgttagcggattaacattagacctatggtgtacctgtcttcgaaacgatgaatacttacccaagctggagaaatatgtcattcctgatctactacagtttgccgcggatgctttagtctattatgaacagattgatggtcatatttccaaaaaatttgcggagattgattttcaatccaagtccgaatttcaaacattttgttccacttataggaaaagaataagagacatcattaggttgatttcttgcgtcgaattagaccttacttatgattggttgaacaacagattaaacaattatttcagctctccatttggtcagcaggtcttaagttccacatttttggaccataaattagagccttatttaggtgccctctcccaatacatgattgttgaatgtttcatcaatggttgtataagatggaagatctggtatccaacaggagatgattatgacgaaaaactagattccatattacaaaaactggaaattttgtcaaaccagttaattgcattaaatttaagagaaccattgttattgaagaaacaaatccaaaattttgcactttttttgacaatgttaaaagataatgtgcttttcacacttttagaaaaaatcataacaagcgccacgatggactatccagaaattaatttggaagagagaggcgctgaatcagacgcagttagagatttgagatatgcttgtggtatcgagttgaataggatggctttattaatgcccgaatctctgaaaaaaatatacccagaccttgaaagtgtcattgccagaatcatgcccaacttatcttaccatgaaaaaatttccttcaaatccttcttattgatcattgtattgaagtcttcattagatatgaaagaggaaagatttgcggctattgtggatccagaacttttagcctggtctgataaaacaacagttgttggtctttctgatttgcattggtttatggaacgcttaggtattgttcagatcgcagaatatttccagaggcgtgatatcgacgaaaatagtgaccttttatcaattccaattgatgatgagggtaaagagctgaagtcggaattgaccaaacgttggcaaagcttgtttcctgttcgtgcaacaagaatgttcattcattattcaatgcaaagtataaagacagatgaagaattcaaaatgctacaagatctgtggagacctaggattgtcccaatattaccttacatcacgagactactgtaccaattgcaatcctaccacgatccagataattggaaaggattacctacggttgtgcaatccttcgtcaagtattccactattgaaagattttgggaggccggagcttcaaataaatcaaaggatgagtttattgatgaacatatgaaagcgatgcaaaccttacgagacttcgccgactccgtaggacacatcattaggtatacaagggaatacactctacttgttttaagtgccatatcatcacttggtagtgttttttaccttttggacgaatcgcccgacctactactgaactctattgccatatttaagccaggtagcaatgagataagccctggagtttcaacacatggatggaaacacataatgaatatagccattcgtcctatattaaaaggttgtccaaaagattgtctggggaaattcatgcccgcatttttgcctaaattatttgaaatcctggacctgctgctatgtcagaaatggtcctcgcatatgaatgatatggacatgaacccagttccaactgacgatgatcaaatgactgaagaaattttggaagagaatttgttgagacaactaaccacagttgttgttagaatagtaattgattgtgttggtcaaggcaatgccaatccaaacagtgctaaaagcaggctaaataaccatcaaatggagatgagaaaaattatatttaatgatttaaacacccttgctccatttttgaaacttttgaaccatttaatttccttcaaggatacaaaatgttcatttaactccatcctagtaatgaaatgctgcttaacctcagtccttaatcaaaacaacacggtggatgaatatttcacatttgaagtgatgaaaaatctgttgctaaatgtgctgtgtaatagtgcgtttaaggattctttccatgaggcactatatgctttcactgtgatttttttgactctgtgcaaagaatatccctctgctagagcgttcctttttgagatatctaatggttataatattgatgagttatacagaaatttaaggagcgtggacgaatacaaaacacaaagggcactcatgattgattttatagattgggttaaatccaccagtgggaaagaagatggtaatgtggaccatgcaggcgatgagagaaaaagacaagagaaaagggaagctatcctcaagaaggcaaatgagagattaattaagaagaataaagaaaacggagacatgctggatgatccgaacattgaagacggtgctgtgggtaatctctttgatgacaactgataataaggtgccatatatacgtagatgtgtagatgaaattagagaaagcaaatagacatctgaatcgtgctaaaaattgtaattattgtgaaaaaaaaaattctgtattcgcaatttttttaatgaaagtcggcagccggtaaatatgcatataatcaagcgttttaatgtgggtctgaacaaggtatttctgaagattttttcttcacatattccctaatattttagcgaaataggaaaccattggcaatggaacaactgtgtaagaggtacgtgcatacaccggcggcttttatacaaaacattgttgctaacactaaaagaacaacgctagccacgcaattatctgttgaaaaagctaaaaaaaaagttcccaagacagctcttaaaaagaaacttaatagtaggccaaaagaaaggcttccgaattggctaaaactaaacgatgtttttaacatacattacgaaaagccatctaactctgatataaataaggttaacagattcttcaacaaggctaaagtggaatttgaatggtgtgcagctagttttgatgacataccagaaaatcccttcctgaataagaaatctcataaggacatattgaaagatcatggggaatgtggaactacattgattgatactttgccagaagtcatctttctcggaggaactaatgtggggaagtcctctatcttgaacaacataaccacctcgcatgtaagcagagatttaggaagtttggcaagagtgtctaaaacaacaggattcacaaaaactctcaactgttataatgtgggaaatagactcagaatgatcgattcgcctggttatggctttaatagtagtaaagagcaaggaaaagtcactttgcagtacctcctggagaggaaacaacttgtcagatgctttctcttactcgctggagataaggagataaataacacagataatatgatcattcaatacattcatgaacacggagttccttttgaagttgtttttacgaaaatggacaaggttaaagatttaaataagtttaagaagaaggttatgagttcagggttaatggacttaccaactctacccagacttgtattgactaactcgcttacgtccagtacatctcctaaacggttcggtatagatcttctaagatatgtaatatttcaaagctgtggtttgattttatgatcacaatatgtatctatatattgctgattgcatttcagcttttaacgaaagtccgctatgcaaaacaggtaacatagctgtaatacgtgagctcaaccagctttgtttgatcttttcttatttcgccgttccacggttttccgtgatagagcaagcaatattgatttgaaaagaaaaatgaaaagcggtcaaggttaaaaacttgcaataagggtatttagcactaggtagtcgcaggtaagcctcttaacaccacattcaggtatttgaagataatacataatgtcgattgttggaaggaatgctattctgaatctaagaatttcactatgtcctctgtttatgggcaaaagatcgtttgtatcctctccggttagcaatagtgcaaaagctgtgaaattcttaaaggctcaaagacgaaaacagaaaaatgaagccaaacaagccactttgaaagcgtcaaccgataaggttgatccagttctgggccgggcggacactccctttataacacgtattatggcagagttaaaagagcctttagttctatcgaaaggttataatattgaagaggtagacaagttccttgcagccattgagtctgctaagcgtgaaagagctgagttgtcaggtttaaatacagaagttgtgggtattgaagacatagaaaaactggaagacagacgtgaagccatcttgagaatattgagcatgaggaactccgagaataaaaatgccattaaaatggctgtagaactcgcacgtaaggaatttgagaggttcccaggcgatactggctccagtgaagtccaagcagcttgcatgactgttcgtatccagaatatggcaaaccatattaaagagcatcgtaaggattttgctaacaccagaaatttgaggatattagtccagcaaaggcaggcaatattaagatatttgaaaagagataatcctgaaaaatactactggactattcaaaaactaggattgaatgatgcggccataacggatgaattcaatatggacaggcgttacatgcaagattatgaattttttggtgataaaatattgataagagattctaagaaagtggcaaatcaaaagcgtaaggagataagaaaacaaaaaagggctacattttagaataatttgaatcatatgtagaaaagcttgtaaataagaaaccgtcatattctttttttttttttgaccgcgtatgaatcagtaatttatttcattttgaattacatcattataaaaagttcttagtaatatatgcattgggtatacaatcacgtgtactatcaaataaagaaatgaaaatacggatatacctctgtaattaagcccctaagagggctgtgttttcatcaggatcgtctgagtctgttaaatactcatcgctatctacttcatcatcttcggtttctttcaaaatctcagcataggtcataattttgtcccaatcgggaaataatacgtaataagcctcaactagcccaattaaaagcatggcacttccaataccaatccaaagaccatacaatttcatgtcaaagaaccaacttaggatgagagccaggggaattccaaatagatagtaagccattaaatttactatacttcctagagattgcatgccttgacccctgaggcaagacccagcaacggcattaagcgagtcgaaattttgcacaatacccaccaagggcaatacttgcgcaattaatttgatgacttcgggatcttttgagtaaatgttggcgattagattacgtccaaatactagtatgcagcaattgatgaaccccgcaataaacgaaaatgacaacccaacttgagaagagatgtgcgcgaaatcggttctttttgcaccaatgaagttcgcaattctcgtagaggtagatatacctattgcaaatgggatcatatagagcaatgcagccatagtagatactgccgactgagctgctagataactgacaccgtaatatgcactaaataacgtcaatagttcatatgacagctcttccgcctccaacataataatacctgagaaggctaaatgccctaaatcattccaatgggtgaaagccttccttgagaatccaccccagcattttcttccatcaatatacaatgcataaaacaatagtaagaaaaacattagccagaagttaagcacaacggcaattgcagccccaataaatccaacaccaatgtacttgttccaaacgagagtgtaactgactaatacgtttaagggagcacatattgtcaaaacgtagatgcctgcatcgaaaataccttgggcttgtaaaaatcgttttaaattttcaaaaaaaatatacgctggcgctcccaatattagtactcttaaaaatcgtgacgttaggttgattaattctttctcagggatgatataagaaagaagaggttcagaataccaccacatgacagcaaaaggtatatatatgaccaatgaaaaagcaatgcaacgttgaaggtgaactcctacactgtagaatctcccagagccatacgcttgagggcatagagtatctagactagtggcaataccctcgaatatcgctagtgttatattagaagtcatggatgctaaggacacagctgctagttcatttttgcctaagtggcccacagttaatgaacataccatagggaaaatctgttccaataagaatgtgaaaattagagggaaggaataagatgccaaaactcttgcttctgatttgaaggtgacgtggctgtgagccaattctgctagtgcctcagaatcgttctcgtcgatctcttggtaaattgtgggaactgagcctcggctagtcacagatacgaatgatggtcttctgtgatgtgaggtgcctttagcgtctgttaccgcacttcgagttaatttctgtttctgagcttggagtctattcataaattcgtcatattctagttctcttccagaatattcttgtattctatctggtgtgttgctttgacttgcttcctcattatcagagttgcataccgatgagtatcgtcgttcatgttcatgtagaatccaatcaacatcttgtggcgaaagctcaggagtttctgatacccttgatggtagagaaatcgttctgctcagttcgccatcttcttcatcatgatagtaaaggtcaggttcctcatcaatattacctaagtacggatttggttcatggacgttacttccaaaatcatctgttaaagatctgaaactcctctgatcaatatttctcgttcttgcacgaaattttcgtaccagaggattcttcttgttgggaggtaggaagcctagcgatatcctcctgtgagtgttaccgatacccataccatttgttcggagggaaggatgcacttctgaaagagtctttgacaaaattccagccattttttcaaccttttttttatccgtatatattaaggtatgctatatgtgtattttccaatgtttagtttttataataatacttcttcagcatcaaatatgcttgcttatgtaaaaatacaatcaagttttgtcccttgcttgcgcgaagatgaaaacttccttaagaaatattctgcatcgcgtggaacccatggaagaggataatagctgacagtgatattatgaaaagatgccaaatggttaccgtttataactgttactggtcgcgtctcaaacgccctcttttttctccttgcatttgcgtttctttagagcaattattgagtaaatggtcttgaaaagaaatagaaatatccttaggcatttcagttcatctgaaaacatgctccaatacgggcaaaccatgaacttgttgttatgaaattaatatacatataaaccaaaaacattgcactacatacttaaagagtgaatacacagtagtttaaaagacatctggcaatttttcaatgacgtatgcgtgaccgcctacgctcatcaaaggaattccagggatttttctaattctttgtttcaggccggcatcgtttgtagctacgatgtaacacttatgttgtaagactcgatgcactaaacagtcatccgcgtacgtacccttgtgcgaacagcttagtctctttattctaggatctcgagccagtttcaaggcgatacggtacttggggcccaatttttctaactctgccatcacacaatctgtgattaacgggttacattttgcgagtagacagtccatcattcctctaacaatatcgacttttttctggatagaaaaatttataaaattggtatctatcagtacttgataaggtggctttatagcttgattgtattgaaagaaaagtgcacttgatacttgtggtatattcctggttagctcagggtcttctttagttttgatattttcctggtttttcttcaatctttggtctttcttggtgttcaaagttctttttacgaggccaaactttcttgttttcttagctttacccataattaactgttgtagtatatcgatatttccgttacaagtcactgttattgtgtgttaatgcacagtaatgtttaaagaggcatcattcaagaatagtagcaagctgaaaaattttagccgttcataatgatacctttagaaatatgccaaatttttttgttatatcttccagtaggaaccgatagtttgagtaatgtttataaaatcattgcaagtgaataagcaattaatggcaatagtccacaaacgataggtacatgaaggtggctcacaatcaaaaaaatcaagctttaaaatagtggatgtagaaaaaataaagtgcgtcacagacaggattcgaacctgcgcaggtaaaacccaatgcctaattgcttttctgaggaaatagcaggcatcgccttaaccactcggccactgggactgaaacactttgaagtgaaagtgtttctagttttctatatcattactatggtgaaaatctatattttcttgattaggaataaaatcatggaaagaagtgttggaataaaaattcactatcgtctgtcaactaatagttatagtatcaatatactatcatatacggtgttagattatgacataagttatgagaagctgtcatcgaagttaggggaagctgaagtgcaaggattgataatgtaataggataatgaaacatataaaacggaatgaggaataatcgtaatattagtgtatagaaatatagattccattttgggattcctatatcctcgaggagaatttctagtatattctgtatacctaatattatagcctttatcgacaatggaatcccaacaattatctcaaaattcacccaattctcaatttgataattgttgggattccattgtaaagaaaatcggtatttctacattataatattacgattatttctccttttgttttttatggttttcattaccctatcacattatcaatctttatatttcagattccattaaatttgataacttggttgatagatgacagttaattctttttccaatagaaacaacgaagacttttttcttactttttgttgatgtttttcaagttctgtttgacccgtatttttctacgttaaaatcgtgattactttacgaatcttgttttcttattttttttcgatctatttaatgaaatgtggacaatggcccctaacaaaaagatggcaaggattgaaataatccgtttatacaatttatatccaattatagaaataaaacacatttgaagaatggcttggtggaaaagtttattacattctttctacgggagttaaacctaacaagcgcataccgttgtataaaacttgtcttgcagcaccatatagagccagacgggcagttgctaattcttcagtttgaccagcaacccataagacgtcataacaagaagaaacctggtgagtcaatttgaataaatatgtgaccacggttgttggctcgtgggttttgattgcatttctcaaaacatcggggtattggcctagcagtctaatcaacagttttgcggcaggttcttttaataacgaaaaatcggcatttatccatttttcttgggtgataccagaagcatttctttcaactgatcttaaccttgagtgagcatattgaaggtatggaccagtgtcaccttcgaatgaaagcattctttcccatttaaactcgtagttgttgatacgcttaccttgcatatcttgaatcatgacggcagagataccaactaaatcggcaacttcttctggatgctcaatttgcgcgtatttgttctcattctttttcataacttcgtgcattttttccttagtttcctccaagatattatctaagaagacaacagtaccttttcttgttgacataccttggaccataccaaagttgacatgctgtagatctttagcccactcaaagcccatctgcttcaaaatttcgaagaattgggcagcgtgcaaatcttgttgagaagcgataacgtaaatcatcttgtcaaaatgatacttttcataacggtccatagctgcaccaacgtctctagttagatataacgtagtaccgtccgatttttgaacaatagcctttcctaactttttgttaaattttgtcaaatcgatcaaaactgcacccttatcctcatgtgttaagcccttttccttgaacaggtcgatagctttgagcatggattctttagaaacttgagattcaccagagtaaacatcatatttgatgttcaaacgtgcatatgtgtcaatatatttttcaatagaaaattcacggaatctcttccaaatttttaaagcttcctcgtcaccatcttccattctcttgaaatattcacgagcttttccattggtggattgttctaatggaatactgtcaccttcttcctcaatatccttgttgatacgaacgtaaacatcgaacaggtggtgaattggatccttaactaaagcctcttcattaccgtatctttcaaaaccaacagctaaaagaccaaattgtttaccccagtcacccaggtagttcattctgataacctcccaacctaatttttcataaaggttggccaaaaagccaccaataatagtggatcttaaatgaccagcatgaaatggcttggcaatgttgggagaggagaattcaataataactttcttgttttcaaccaatttgcaagaaccataatcctcctttctggttaagatatctgggatgacaagttttgctaaaaattgagggttgaagaaaaactggatgaacgggccattcgcttcaactttctccaagaaatctccacatggaaatttttcagcccattggactgccaaatcctttggattggcacctttgattctcaatcttgggataggaatcaacaaatcgcctctctccatagtatttgtccattctaatgctggaaaaataagagacgagtctacgccggaaatcttgcttaattcttgtgaaatgtaatttctcatcaaatccacgatatttacatcaggatgagaatccttggcaaccgcaggttccgcgatagatagtttctttagttgagaaatcatatttgctgtgctagccattctgtagaaaaacgagctattgctttttctttgattaacagaatttacaacactcaagaatttatttcgtaaccttataatatcctctccatagatgcattgtgaaaattgaagctaaaaatttttttcgcttcgcatcatgaaagtaatttttcttcttttaagtgacgggcgatgagtaagaaagaaataactgactcattagacactttttgaagcgggatacagaaaaagaagatatttcccatttcaaaaaggctctactatatccttaccatttaccaaactaaccaaaatttgtagacgtgggtctgcaggcaaaattggaatatttgtgaataacagtgcggtcggtaaacaactgacttcttcccactttgcatttctctttaaagtttctttgtctccgtcccactcaactttctgagaacaaatgatcaaaaacttgaaaattaaactgtattattttgtatatattaaaaacgtatttacttttcaagatatcattaaaaatataaaattagaattagagtacatttcaaatgcacaaattagagcgtgatcatgaattaataaaagtgttcgcaaattatttggtgctgaacattctcttgtacaatggcttgtcatcgtgagtcatttcttcagcgtcgtagttggcacctcttctggatggtggaacccatgaggcagacttccatggtagaacaccttcttcccacatggtgttgacttcttccaaagtcaaacccttagtttctggaacaactaacaaaacatagaagaacatgaagaccaaacagcccatgaaaacgtaaccgtagtagaagttaatagcaccagtaataaatggagtgaagaaaccaatcaagaaaccccacaaccaattagcagctgtagcaatagacatagccttagacttgactctcaatgggaaagtttcagaaacaacgacataaggaattggagcccatgtagtagcaaaacagaaaatatagaaacaggcaaagacaatcatacagttaccagcacccttggaagatggttggtcttgaccatttggccataatctggtgacacccacggaagcatagacaaccatacaagcagtcatggatgcagcaccccatagcaaacaagtacgacgaccatatctctcaacaacgtaaataccaacaaaggtggaagcaaagttaacaatacccaagacaatagaggtttcgaaagagtcactcaaaccaacagccttgaaaatagtagtaccatagtagaagaaatagttatcacctgtcaattgttgtagagattgaatcatagcacccatgatcaaacgctgaaggacctttgtcttgctactaaacaattcaccccaggatgcattaccagctaatttctctgcctctacaccagccaagacagcttcgacttcagccaaaacagatggatcatcaacagcaaccttgttagaaacggcaatagaacgtttggcttcttcgatcttaccgacttcagccaaataacgtggagactctggaacaaatgtcataccaccaatcataaacaaagcccaggcaaaacacaaacctaatggaactctccattgcacagagttggagtagttcttagtaccgaagttggtacagtaacccaagaaaataccggcagtaatcatcaattggtagcaagagactaaagtaccccttaaatgctttggggatacttcagaaatcaacataggagataaaacggcaataccaccaacacccaaaccggaaataattctaccgatgaaatattggtaccatttgttgatagatgcaatttgaataataataccgatgatgtagatgacaacaacgacaatcaaacccaccttacgaccgtacatatcacccaatttggaaagaataataccaccaatggcacaaccaatgttgaaaatggagacaatcaaaccagttctaaccttagacaaataattagtaccatctttatgcttcataccaaatcttctgatgaaatcggtttgattgatgaaaccagaaatggtaccagtatcccaaccgaaaacgaaaccaccaaaggcgatcatgatacacataatagagacagtgacataggcagaagctggtctctttggaatttcaacgacaggttcgtgctcttcaccttcaccataagcttttatttcatctctttcagccttgtttgatggtgtagataaaaccgagtgggaggctgagtcaacagcagagagatgctccacaggagtttgctctgcaatagcagcgtcttgtgacattttttgattaaaattaaaaaaactttttgtttttgtgtttattctttgttcttagaaaagacaagttgagcttgtttgttcttgatgttttattattttacaatagctgcaaatgaagaatagattcgaacattgtgaagtattggcatatatcgtctctatttatactttttttttttcagttctagtatattttgtattttcctccttttcattctttcagttgccaataagttacaggggatctcgaaagatggtggggatttttccttgaaagacgactttttgccatctaatttttccttgttgcctctgaaaattatccagcagaagcaaatgtaaaagatgaacctcagaagaacacgcaggggcccgaaattgttcctacgagaagtagtgggtcataaaaagtttattccctggaaaaaaaattttgcgttgcctttctggagaattttttcgaattagcgtgctgccactgcatgcatttctgagaagtgtgggcattcttccaccagttgttcctcctaaaaaaaaaaaagatttcctaccccgcacaaattcctgcatacccctcatttccacggggtaaaaaaaaaacatcccgtagcagcctctgacggagccgtatggaacaatcctggataaatatggcggaaaaacggctctggctgcggctttgtttaaggcagaaactagatgagatgtttgttgttacggaaaaaaaaatttgttgcgctttctgtagtgggatttgtcctcataacttctccatgaaggggccattaaaatctagccctctagtaaagcgttatgggagcactcttgcggcgttcaacggtgctgctttttcacttttacagtatgatatgtctttcacattgggttttagctataattagataaaaatattttaagttgcttttgaagtgtttagtagggcgtgtttagcagggcatgcttaacaaccccaaatgatcttagcgatgagagtactattttctagggttgttttgtgcagcctgttaatgtagacatcaagaaattaaatgcgatcttaattcattcggaatttcttttcaccgtgtgaatgaaatttttcgagatgctaagtataataaaaataaaaaaataaaatcgcttttcttctagagaatttttccgtgagaaagtaaaaacacataatactagcttaataaacttttctttccaccacccataggatacgctaacaatttttgctgtcaactgcttgccattttgttttcttccgactactatcacttagggctattggcagtatatgcgtaattttatcaattaccatacttgtcaaacatagatcaggaaaaatattaacgttcctgtcaatctaagacttgaagattacaggacttttttttttcttactgtatttttccgtagagtgcaccattcggcagatggatcgcggggaaattgagagtttatgcaaaaaaatccgaaggtggaattaaatgggtcccgctttggaaagccccggatttaatcccccattaaggcaaattactcctcatcctaggtggagaaaagaaccggaaaaaaatgcagtaccttttttgttcccatttcttttccaagtaaacaggcggagaatcaagctgctgcagttagttctcagagttcacttaacgttctcctgtaataaacataaggaacaaccatcaccccacacttttatctcttcctcactaacattgtgttagcttgcatgttctttgagactaatgaccgattgtttgatctcttcttccgattattgctggtccgatcccttgagcatcgaaaaccaaacgactgtttaagatctgtaattgattaagacccattggcgattactcactcatcggcaaaaaaaaatggtctgaacatgcgttgaaaattttgctcccatgagattttttgtctcatgtagtaattattttatttcttgagcaatctgagcttcaacaagacagaaaacgaatatggcaactgttatttcgttatatagtgttgctggtgaccgaacacaaaaatgatcttagaattgtaactcagggagcatacgaacaaaagattattagcatttcgtactttctaaaagttgaagaagttggcatttgttgattttatcatatccttaataaaaagttgacgtcagcatacaatttgaaaatagcaatatcgaatgcctattcctcctttcgttgtttgagtttacctaatatatcgatgcatttttgcaaaagtgtggtattgagcacgcggtactagaaggaaaaatctcttctttttactacgtgtcctgcatttctatcatggtgaagataatcattattttatgtcaaaaattactagttagctgtcagaattttttgtttaaacattgttgaattcctgtcgcaggttaaagaaatcgaaaaatagccaatgaagtagacagaatcatttgaccagttaggtaaattactgtgtcaaataattcaacaacgcgtttctacgtggtgggcagaagtccctggaatactttagtgatggtacacttttcgacattagaattgtctctgaattgtcaccccgctaataagttatttgtatggacgccaataaaaccatacaaacgcggctttctggtactgcgtttaatcttgcatgaacttttccgtccattggggcgaatattcactgtgcgatgtatactacctttttagctactgaagccactcttaaagcatgatttttttccttcctgccatctaaaggttacttacggcaacctttccataaattgttgctgaaataacatataatagtaccaaatgggcctatcaataagtttacagcctacaagattttcttccactaaaatatattcgaataggactttggccaaaaactgttcattaaggggcagactgttcatgttttctcgcaaattacctttttaacaaggtgaaattattttttttggggaatgctaactgtttatcatctgccaggaaagaaaacttagatcctctttaccaatcgccgccagtagtacatcatttcttattaaataaaaacattttcatatcattaaccctttttcaaacatatatgggatgtagtttgccaaggatgatcataaaggcctaatatgatccccattttctttttattaccaaaaattcaggtttattgacaagccttctctactctgtcgcaatgccagtttaacattgaggagtttagtagcttcattgtaatgaggtgactctatttaatttcaggtagaaaagcgcagtaccgaggtgagccctgcatatgtacactgattgtgaaaagctccggctcataattaatttttttgatgaattatagagtactttgtttataatagaagactttttttttcctcctaaggtagcttatgcgagaaagagcgcctacttcgcttctagcgctacaaaacaataactttgaagggtaaagctgttaacttttcttcaaagcttagaaaagaaaaaaaattaataaaaaattatacttctattggcaacatcttgccatacaatataaatcgtaagggttcattaaaaatataaaatcagaattagagtgcatttcaaatgcacaaattagagcgtgatcatgaattaataaaaatgttcgcaaattatttggtgctgaacattctcttgtacaatggcttatcatcgtgagccatttcttcagcgtcgtagttggcacctcttctagatggtggaacccatgaggcagacttccatggtagaacaccttcttcccacatggtgttgacttcttccaaagtcaaacccttagtttctggaacaactaacaaaacatagaagaacatgaagaccaaacagcccatgaaaacgtaaccgtagtagaagttaatagcaccagtaataaatggagtgaagaaaccaatcaagaaaccccacaaccaattagcagctgtagcaatagacatagccttagacttgactctcaatgggaaagtttcagaaacaacgacataaggaattggagcccatgtagtagcaaaacagaaaatatagaaacaggcaaagacaatcatacagttaccagcacccttggaagatggttggtcttgaccatttggccataatctggtgacacccacggaagcatagacaaccatacaagcagtcatggatgcagcaccccatagcaaacaagtacgacgaccatatctctcaacaacgtaaataccaacaaaggtggaagcaaagttaacaatacccaagacaatagaggtttcgaaagagtcactcaaaccaacagccttgaaaatagtagtaccatagtagaagaaatagttatcacctgtcaattgttgtagagattgaatcatagcacccatgatcaaacgctgaaggacctttgtcttgctactaaacaattcaccccaggatgcattaccagctaatttctctgcctctacaccagccaagacagcttcgacttcagccaaaacagatggatcatcaacagcaaccttgttagaaacggcaatagaacgtttggcttcttcgatcttaccgacttcagccaaataacgtggagactctggaacaaatgtcataccaccaatcataaacaaagcccaggcaaaacacaaacctaatggaactctccattgcacagagttggagtagttcttagtaccgaagttggtacagtaacccaagaaaataccggcagtaatcatcaattggtagcaagagactaaagtaccccttaaatgctttggggatacttcagaaatcaacataggagataaaacggcaataccaccaacacccaaaccggaaataattctaccgatgaaatattggtaccatttgttgatagatgcaatttgaataataataccgatgatgtagatgacaacaacgacaatcaaacccaccttacgaccgtacatatcacccaatttggaaagaataataccaccaatggcacaaccaatgttgaaaatggagacaatcaaaccagttctaaccttagacaaataattagtaccatctttatgcttcataccaaatcttctgatgaaatcggtttgattgatgaaaccagaaatggtaccagtatcccaaccgaaaacgaaaccaccaaaggcgatcatgatacacataatagagacagtgacataggcagaagctggtctctttggaatttcaacgacaggttcgtgctcttcaccttcaccataagcttttatttcatctctttcagccttgtttgatggtgtagataaaaccgagtgggaggctgagtcaacagcagagagatgctccacaggagtttgctctgcaatagcagcgtcttgtgacattttttgattaaaattaaaaaaactttttgtttttgtgtttattctttgttcttagaaaagacaagttgagcttgtttgttcttgtttttttattattaaaacagaaaaattggaaaaaagaagaagatagttacaaaccatatgtcttttctcgagctctttttatatgtttctgtgctttctatattgtatacccatttgctctccattgtctgcaagccaaaatctgcatacagatccgagacatctcttggatttttttcaatgaaggcacggagggcatctgaataatctcaatgagtaagaaacgaaattttttaaggaacattttcaatttgcctacggactattctctgcaaagttccaataatttctcctttttttccagcgtttaaaggaaaaaaactggttttcgatgccggggccccacaatgtacctgcactttttgtggggtaaacgtggataaaacgaatctccgttgcctaaaaaacattttttttcgtacggtcccctctgcgttcaggaaaaaaagagatcgggtggtgaggctaggtagcgtagccccttggagaagcatatgaaacatttgtcttggcgccgcacacaggaactgcgcacttctttttgtcctaggttgcttatcacaccatatggtgcacccgtgctcgttgtcactgcctttttttaacaattcttcctttgttcctctgaaagcacgggccggcgcactccaattacccctacattaatttccaagtagtagcagggggatgaacatgtgaacatgttgcaacaactgcggtgtcttcttaggcttgtgttcggaatttcttcctcctgtttcggtgtgtgttgcttattttttccttgcccctttgcggcatcacagcagccgttgttccgtattccggctgataagcatggaaagattttccaacaatactcatgaaaaaatgtgttggtgtctgagtaagctaaattttcccaaatttgatgccattcaacccgaaaacttaaaatgtaaaaggggttgagatagtgcagctgtgtggcaaaagtcaaaaaaaatctgttcctttcaaggaaatgaaaaaaggaaggaaaaaatgtccaggacagaaaggccatccccttagtaaagaaacctgcttagagattcttgaggctcgaaaatggttggtggttggacttcttttgagttttccgtccggatttcaaacgaaatccatcatcacgttcctagcaacaagaggattattggacgattgtcgggagtaaagattactcagttggttttctaactctactgcgcacttcttcgtgggtataacaaattgcacacacatacattcttattatttgatactgcttacgataaccggagacttcttttttttcctgttcggctctcgccgatggtatgaagttaaatggtagaaaaattgtttgttttgtttacaaactggatcaagaaatgttaaaattctgtttgatatcatgtaccaatgtcttttattaactgtatcagagaattatatatataaagtcataaatcttgtgtattatttatcattattgactagcacatcgaatcttaaaatacactattattcagcactacggtttagcgtgaaattatttcttgccgaacattttcttgtagaatggctggtcatcatgcatcaatgcatcagcatcgtagttagcacctctttgagatgttggaacccatgaagcagacttccatggtagaacaccttcagcgtacatatcattgacttcttccaaagtcaaacccttagtttctggcacaaagaagaaaacgtagaagtaggcgaaaaccatacagcccatgaaaacgtaaccgtagtagaagttaatagcaccagtaataaatggagtgaagaaaccaatcaagaaaccccacaaccaattagcagctgtagcaatagacatagccttagacttgactctcaatgggaaagtttcagaaataacaacataagcaattggagcccaagtggtagcaaaacagaaaatatagaaacaggcaaagacaatcatacagttaccagcacccttggatgaaccattaccttcaccatttggccatagtctggtgacaccaacagaagcgtaaactacataacagcagaccataccaatggcaccatataacaaacagttacgacgtccaaaacgatcgacagtgtacaaagaacaacaagtagagaagaagttgacgacaccgaaaacaatagaagtttcgaaagaatcactcataccaacagcgttaaaaacggtagtaccatagtagaagaaatagttatcaccagtcaattgttgtagagattggatcatgatacccatcatagtacgcttaaacatggccggcttaccagtgaacaactcaccccatgatgctgaaccagcagctctagcttcttcaacactagcttcaataacttccaactcttgttgaatgaatggatggtctggggcaaccttgttaactttggaaagagatgctcttgcttcgtcaatttgaccagcttcaaccaaataacgtggggattctggaacgaaagtcataccaccgatcataaacaaagcccaggcaaaacacaaacctaatggaactctccattgcacagagttggagtagttcttagtaccgaagttggtacagtaacccaagaaaatacccaaggtaatcatcagttggtaacaggagactaaagtacctctcatttccttaggagcgacttcagaaatcaacataggagataaaacggcaataccaccaacacccaaaccggaaataattctaccgatgaaatattggtaccatttgttgatggatgcaatttgaataataataccgatgatgtagataacaacaacgacaatcaaacccattttacgaccgtacatatcacccaatttagccaaaataataccaccaatggcacaaccaatgttgaaaatggagacaattaaaccagttctaaccttagacaaataataactaccatctttatgcttcataccgaatcttctcaagaaatcagtttgggcgacgaaaccagaaatggtaccagtatcccaaccgaaaacgaaaccaccgaaggcaaccataacacaacagatagacacagtgacatatgcacctttacctgtatttgggttggtaagtacttggtcggcctcagcttggaaatcatcttgaacacctttttcttcaggcatgttcattacctgagagctattcgaaggcaggtcagcattcgaattctcacttgacttttgtggagatattaaatctggagttgaattcatgattgtttaactcagatgtaaattttgtttgtgattctattatttatgaaaagctattaagtaaaattatggaatattcatgctgaagataaaacagcgcctgtatttatatgcaacccccaagcgaaaaaaaactttgacttttcttctcttctggagaaattctctggggatatagtccccagattttttgagtgggcccccaatgtcccacatcgttattgagttgtttctttctccagaaggtcgttgtacagtcattataatggcggtcagtataatgacctccggaaataccaacatcggggaaagcggaaaatctggaaaaattctccacgaagctttctctgtgataatccgcgaccgagagtttaaccgaatccgcggaacgagatattccgtgtttattgcggtattatatgagccggacgaatccggaaaaactacgtgacaggaacgatgaccgggcagcaggcgaagctggaagaatatagctaagaaaatgcgcacggaaaaaaaacactcccgaatttctccgtgaaaagagcctactaggggataatagtaggtatccgttaatattaccgaactattgaaaacctaccaaatgcaagaagatgcaaacgagctagaatgttccgcgaatagctcatcttacaatttttttcttttttcaagaaaaagaaagtatttttttttcctttcatttcattgctcctcctccaggtgttatctcgagaagatgaaggctgtctgcgatgacgaataggaaagaaaaaattttccttaattttgcttgcttaattcttatacgaataattcttcttaatcaacatcgggcttcatatttaccaacacgcattattgattaacaatacttgccttaggttgaaattggacgccggaagagaatttatagctagtcagtgttcttcggcgtaattttattaatggacatacagtgtacttttcaaactacaccgccatttgatataccggtgtaatttttgatgaagtgtcagaattagccgcacagttaattgaacacttcgctgtaaggtgtggatacagattagataagagcattaggcaccacatttcttcaggcttttcctgatgctggtttggatattgccttcatcccgcaccaaagctggcgtcccgcatgaggaaaatgaagagttgtaagcagcactaaattccgaaattaaagggcgggcggatgccaccagtaaaatattcttgatcaatctttgatattttcaaatgatctcccattgtaatctgagaactgctcttgtttggctacgtaaggcagtatgagggttgtagttagtagtaaccctgtctaagattcccggtgctatgtacttctctcacaataatacaagtagtgaatgtcacttaataaatttttgtaataaaaagtctacaaagtttgtttgtgacttgtcgaaattcaattctgttgctttcatttttctgtagagaagaaataatattccgacaaaatgtaaataaatatgctaaagtgggttacgacaaatttcttgagagccattgatttttgctatagaggcatgaaagcatactgcacacacatccaatacttaactttggcaaatgaggagcctaattacagagataacttcaaactacataaagaaccaagatactagttaatggaacgcctagacgatcatgcttaactgaacgaaaagtaactaatgaaatacaagtctcttttcgccgaaatttgaatttaacaagtctagtatacccattgttagtgcatttctccgtgttttgagacgctttttttacatgcttctaaataaaggcatcatccatgctcggcagccgtagaaaatcattagcccctaacttccaaaaatagactgcgcgctacgtgagacgcttacttcagctgtagtatcctaacgtgaaggtttttttaatttaccccataaggatcgcgtcaataggatcgtttccattttccgactttgcagattagatggatccctaaaacgaagtgcatagttgcggtattttgtatttgagccatttaaaatagtctggaaggttttctttttgattaaatacatttggtgtttcattaaacctggaacaatacatatgatcacttcatcccgataaataccaagccccaggaacgtacttactcctaccagcacctgtattataaccttttctgagagttcttttgttttgcttgcaagggtatatttcgcagatatccacgaaaactttattcatttgctcaggctatattacattatatatatatatgtatggatacataagaaaaatgagatgaataaaaacgacaactatttattatggcaacattgtttactgtggctatttctcgcatcactcttattttgaacaatagtatcgattatgtgacgcaacaattaaaaaggggtataacgataacttgctataattattaaaatttgcaatattagatttgtgtagtattaaatcacagataggaaaaagcatacgagaccttcccacttttgctcatgcttcattgtaagactcctcactaatcacatctgattcagaaatgaatgttacttcggtccaagctacaccgtgaattttctccccgccatttatttgtaaagttgagctttttggatcagcatattggtatataaatggcttagtaccagcaacaccagagacgatgtttttaacaaaacttggaatttcgcccatcacatcaattctttcaactaggttgttcaacggaccctccacaacagcacagatcttattttcttctgcgacgttcttgtattcttcttcctcttcatcttccttttcatcttccttttcatcctctccttgtaaagcttgttcagtcccattctcggattccaattgttcatccttgactttggtattgatacctttgaaggtgatcttaatatcttttggaactttccaaccaacagaatcaatttctgagtttaagtgctcaacaagattgttagttgtcatcgctaaaacttctttatcatcggtaataataccagcagaaattttagtgttggcatatgattttggtgtagtgaactccatcaacaccgcggaatacttttcggaatggaaaaacatgaagttccatgccttagctgcgtgatgaggcttcatgccttggaaggccattataaatgtcgaaatcgcagggtcttcctctttaaaagtaatcgtacgatcttcataggtgatttcgacttcttcactgtcgctttcttcttcactaccagattcctcctcagaatcaccagactcttcatcttcgtcttcattatcatcctcatcagctgaggattcttcttcatcagattctggaataacttctttcttaactttgatagtaccgtgacaagcattccttggccagaaaacgtgtctcatgctaccccatggttcattgatattgttaccataataagtcgcaggatcatcgcctatcttggctccaggggttaaccttcttatatgcaagtcaacgacagataaatcacaaacactggattgaatgtgatagctttcaccgtcttcacttaattctacagaaagattgtcggcatagaagtttggaccttcgatgtaaaaattttccaacttggtggaagtccagatattcaaatcctctggattcttcgagtcaaaaattctgaaagtaaattgggatgcagtgtgcaacccaatgatgttcgaatgaataacctgggcaaatccaaagatacctgttttcaagtcactgaaataaaagataaccgattcaacgtttgtatggtcaggagcttgccaaaaaaaatcttcacgactggtttctctgtaaggctgcttattttttaccctatcagcaacactatgaatgtaatctttcccatattcaggctcagccataccagtgactgctgagatcccaccttttatccacttcaacattatattatattatacaaaagcttattcgtttcttttttcttgattcgatgcaataaatgactgaatcttttgatcttctacagatttcaaattatcaaacgaatacaaaagaattctatcaacaggctctatctatatataacaaacgaaaagccgtgctattcgtgaatctcaaggagtaatcttgcaagatatccccgaatgtttcaatcaaccagctgtcatttcgcttttgttttctcccactcatcgcaagtttgcctcctcaacaacaaaaaaacaacgaaaaaaagcggtactaaaccggacctgaagttccgtggaaagtgagatttatattatgcaggattttgctcagattctctcaagagcaatatcataatgcataagtgatgaaaagtatggcagaaacggtgggaggaaccgcagttttagctaggatctggaaacaatcagtgatttgccatttaacagctgggggaatctaaatacttttgaattttaaggtttccagcaccatgcttcgctttactggtgctcgcgctattagaaagtactctactaggtatgcactcgagcacctgaaagaaggtgctcctctgaaagggctgttttctattgaaggattacagaaagcatggttcgaccgagtgaaatatctcgatgcaaaattgaacgattgtacaaatgaagcgcaacaaaaacccttagaaactctcatccatgaaaattcgaaatctgcttcaaagaaacatatcgtgaactatgcgtcatcattgtacaacttgaaatttagcatgtcttcccttcagggatgtatcaggactccgccagaggaatgccccaggctaggtccagaggcgctacttcagacccctgatttcaataggacaataagcaatgagccattgaccactggcaacgaacgtttgcaagcagctctaatttcttcatttgggtctttgatggagttcagaacattattaataaattcaaatcttgctatatcaggcgacgggtttacgtggttagtcgcaagacggcagctcgacaaacgtgctatgcgcaacgacatgccaaacagggatattgaatatgataagctgtttatattgaatacgtacaatgcgggaactcccttcaacttctctacatctggggtaatgaatgagctcaataaccaatataccaacatggaaaaacaacgagccaaagaagccggtaatcttgaagattctgagatgactgccaagcaagccaagacaaaatttatttatgaaacccaacagaaaggtttttctgggaaagaggtttcatatatcccgcttttagccattgatgcgtcaccaaaaacatggttaactgattatggcgtatttgggaaacgagaatatttagaaagggtatgggactctatagaatggaaaattgtagagtcaaggttacctcaacgtactaagatccaagcattcaacacgttatgaatgaaactggtaatgggaattttttccttttgatataagttggtagtctctgtaaatatataaagtcaaactattcgtaatgtgtatataacgtggtcttaaattatttttattcgtatctctcccttttatttgcctggctttggtgtctcatagcttcttttctctcttttaagctcactttactgacttttcctgccgacctttagactttttactctgctcagtaatttgctgcccgtcgatttctttttcatattgggctcattgtagcgcacacccaaataaacgtcttcctcatcttcattgtgatcatcttggccgtcgaaatcagtagtataattggacttatgcgttctgttaggagaattaacggttttcgaccttctaacaccttcattgctgtgaccaacatcatagttgtctctacttaaactcaagtttcttctaacgcctgtcatgggggcattgctatcaccggatcctccgagacctaatcgttgagaaagtgacttatttctttgtaaaccaccgttacgattatgataggaatgggcttttatgtcgtttctaatggcagctgaggaggccggcgccccatctaaaaacgtactagaacctaatcccgcagtaactggcccatgaaccaattctgtcttatttttggcatccatttgttggacgttacccacgtttgcttttattgcgtcctgcgtatcaccacctctccttagagtctgcgaactgtactggtatatatcagaatcatctgtatcatctctcccaaaaacctcatccagggcagacttcttggttgaagcgccaccgatggtactgtttggaccatcgaccggaaatgctaaaacaggcgcagctttgttatttttatttctatgaggtgttactgcatcgaatgggccgtcatgatgaaatgagccaccgaacaatccagttacatctaacttatcgatagtatcgacgttcttaggaacaataaccttactttttctctttcccttcttagaaggcgttgaagatgaggaagcttcacggtgatggtgggatgaagatctgcgtgaaatatatgtgccgctgttgctatgttcgcggtgagaagaaggacgagaaaccttttcctttggatatgcacgccttgatccattggttgaagtgatctcttcgtatgagggtggtaggtcagtgttttctcttgtgttacctactgtacttacgtcactttcctccaaatatctttgccttaattgttctttttcttctttagcagtgggatgatttttattccttgaaacaggtgggggagaccttctaaaatcggttgcagaactcacatcgtctaggaaaggattctttgaggaaagaggtctcgaaggtggtgataaactaccactactaaagctctccaaaccagaataaaaagcaccctgctgatctgcgtttcgctggggttcatcctctggaatgtttgggaatgataattgtgaagaagttcttgtgttcaattgtggcatatcaaatgaattggtacgagattggtttttcgcccactcctgaaactgggagtcatttttatactgattaatacttgaatcaactgtggcatttctaaacgggttattaacagaaaatggcctactagaggtactactgtttctattctccatgctaaatcttgcgtatatgtatcaatttttctaaaaatggaaaatgctggcaaagtgtaatggaacctacaatgtatcaacaattaagcagtcgaagattatggtaaaatgacgttacgtgttcgaagggataggtctgcaaaacacttaaattcctcgaataaaaataacaataaaaagagcgaggtagatcggatatatttcggattctacacactataaaatacaaattagaaattttacagagttacctcccaagaaagagtatcttcattttctagtgaataacctatcgccagtcaccatgatctgctgttgaaccaacctcgaggcgggaaaaaaaacaaaaaaaaaagtaacgcgatttacgctccgtgcacgacgattctttgagatggctgccaatggttgatcacaagtactagcttctacacaactggataagaatgacgcatatatacttttaagtatgttgttattaaatctgctatataatgatgttatacgtgcattggtcaaggagaaaaaggttttatgttatgaacttttgttaaaaccattcaaagaacaataagtatcgagaatatcgaaagtagtagcaaggaagctatacgagttacatgtccagctggatctttgttaaatgtataaggactgctcaatcgaacgcctgctcccgaagcactgctggttctattagttgaatttgaccactcttctgaggctgacacagaaaagctgtcgaattgagtactggatggtctagcacttgtgcttgctcttgaagtatcatagaatgaccggcccgcacctgtaatcacaccgtttgagtatgctgctgtcagttgacctgggacagtgaacatatagcctgacctataggatggataaagagtcaagtttcttgtattactactattcatcacttttgcgtaaggaatgtaaccagatttgatcttcttgatgatagtggacgcggtagtttcatttgtctcttcagtaactgcgtcatcttcaaccttctttgcctgtgcaatggctatagtgttatcctctaagtccattgccatatatatattttttatgaaggcttctccgagtatgtttactccagtatttgtattagcgtatagtgttagaaaacaagcttcctgtccagaactgaaaaacattgaagaattggtggatgtatcgtaagtagatgataataaatcacgtaggggtatttcaattgtcaattctcgaagcctgaaacccaaggagacacccatatctgctatagaacattggactagccacctatctagtgattccacataagtggccgcaatttgaacggcaatctgaataatggtactagttggcaggtaactgaccgaagaagttgaatcaagtaaggctgggctcagaaagtccttcgaagtcatattcaaactttgtccgctgttagacacaatataaatagggcctaatggcacaattgggtacccaacactaacagcattactcactgggtcaacgtaaggaattaagtcaaattttcccagtgtaccggtaaacagcgaaggatccacccctccaagaagtagcttcccacaattagatattggatctctatatgttttgtacgtggaagtgtctccagccaaccacagtgaatatgacgaactttcaatgatatctgcatctttcaataaggatagaaaataagactgttctgtgtattgtgagctatcgatagcattgcctgggtttgtgaccttcccgcttaaacctaacaagcctgaagtcttaaagttcgaggactgaatatcaaagaaggaaacgtttgaaatggataggctccccgagttaaattgtacgttatctcgagttaccattaaatcggttatcaaagcggtcgaggaattttctgaggaaacatttgtaaaattcatatcgtctgtcaccaaagtacagttaacagctctaccatcaatgaaagaaatctcatatatttggccaggagaaacaggaacagatgatgtagagtcattcatgaggtagctgggatgcttatgatatacaccggagtattcgttatgactttcgcttgttccggaaaccagatttatgtacggttggataatatccactagcaaacgttggcgttgaccgggagtgccaaatgtgctattaacatagtagtttcctctaccatctttacccacggctagtacaggaaacggctcctccgttgacgaagaggttccagactttgctgtagttgttgtatttgcagtactagccgttgcaaactctaactgaaaagttgatatgagccacagataccataaaattaggcatgtcatagcaaaaatcaacggcaaataaagcaagcacgcagttacgatacgttcaaagatctttccaagttctgtatccttctagaacgattagtctaatgcaactgatatgtccaacattctaaatataacttattttggtattagctgcatcattctaccatgatgagctgcggcgttcaatatctcatttttttttgttcggggtaacgaggttcattgttgcaaatagcacgaccaaacgagcggtatgatacaaagcactgcaagtcatagctgaggtaaaaaaaaaaagaatgaagatctcattgtttgggttaaattactttcaagagcctcttttttaggctcggttggttaaaagagcaagaaccgaaacactagtgcatcaatttttataacaattttgtaattatgttgataattggcagtaaagttacaaaatacacactaattaaaatattgaacacttacaatataaagctgatatcaaaataaatatcgaacaataaatacaactctctccaatatcaatatactgccgtcgttatttaaaaaattagcccacctgggaacattatagaaagagatttgttttttggtctggcaatgtgtcataatcaagctctttgcaatatacatccccaactcatatatttgtatacaggaagaagaatcgaccaccatctatcgactagcatattatcatatacggtgtaaaaagatgacataaaagatgagaaacagggtaatcccaacaattgtctcaatatttacctatttctcacattgtcaccgctcgaaagtgcattttatatacgttcttttgtgacgactacttttggcgggaatcttagcgccttaaatgcagtgaaagattactcttttgagttattgcctgaattttgtctgcaaaattgttattattcaggaatttagaataattcaactctggaggcctgcgctgtactacgggctcaagtaataccggagtgtctcgacaatcctaatataaacagtcttagggaagtaaccagttgtcaaaacggtttatcagattaattcacggaatgttacttatcctatatattatataaaatatggatcatactaaatggtggaagcgcggaaccttggatctaaactgttggaataagaatccactatcgtctatcaactaatagttgtactatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccatttagaggattccaatatcatcgaggagaacttctagtatattctgtacacctaatattatagcctttatcaacaatggaatcccaacaagtctctcaaaatacacccatttctcataaaccaattgttcaggcatttatacgtttagatagcccagctatagaaggcggagttttacctcatgttgctcaatctgttcgttttcttaggtttcatatgtgttctatgaacgttcaggataatgtattgtcatgctgacgtatcccattctgagatgtaacgtctgtacaaaacaaagcttcagtagctcagtaggaagagcgtcagtctcataatctgaaggtcgagagttcgaacctcccctggagcatttttgccgagcacggtacttttttttattctcagtaaatgaaatccaagggctcatttatttgagaaagtaaataaggtattagaggtaataaagtaaccatgggccaagaagacatattcataaacttatgaaaaaactttgtaggtattaataacttatgggtaaattactatctatgaatgaatatttactatttactagtgctcatctggatattaatttagacttttcaacgtctctcttataatatttgtacatttattaacatcatcatcattaaatctaggcttgccatcttcttcgaacatatcttcgtcagtaaacagggtgctatcagtaggttctttaatgttattattttccaccaattccgtcagtaaagtttcgtcaaagtttttgggaaacggccagccttggtcttttattatctgtatcaaagccatatgcctgatttcaaagcccccgaagagtatcttattgtaccaggagcgtgctctttttcgtctctcattttgacataatgcattaccattgcagaacaaaatttaaacgttaaaggcaccccatttttatgcatcacctgtagcaattctgatagttcagcctgcgttaatgtatgatttttataggctactatggaaaagggacatagcgtggtagttaaaaccacttttttggcgaaaggttgagaataaaaatccagaagaacattgtaggccagccttggttcacgagcttggaatctaatataatttaggaaaacattgaggattccggtatcatttctccaatacctgtatttatgagcttcctcggaaagaaaactcttgtacttgtaatataaatcaagaagacaattcttgaattgaccactttccagtgaaacagaactcgaagataaaaggcttctatacagttcagttaaaattggaacagtcactggtgatcctattcgcattgtgttcggtagaatattatttttgttcttcagctctcttgctaacgtaggagctgtcaaagtcgttgattttgaatgatagagccacccccaaatccctagggcattcagaatattagcagacgcctttgagctgtatgatgagaggagatatttacacaccaatttcgggtcacgaaaggcttgaaaagatgcaattaattcacccattaaaaactccttgaacaatttatatttcatcagtgggctgctttgtaagcaggaaattacattgaaaagctcctcctgcctattagatattcggagcagattcaagtagtggtgaatgggaaaattcaatatgtgttcgtttccatcaatgtgattaagcaatcctgagcttacaatgaatttcagttcctcttgaaaggttttgatgaataactcaacatttccacttttcaaaaggtaataaagtaaggtattgttgaacttgacataacgcaggttcttttgctttgctccatctttaccagaataacagtgctgttccaacttctgtagtagagcttgaataaatactttaatgaacctaaaatttttcgccttaacaaggccatttactagagcgattaagctgtcaaatgtatgcaacttcagaactttttccattataaattttatgtttgtctcatcatgcaaaaatatttggaacgtggctaactgcctctccatctcagttccttttatcagcctattggtaaatctcgtacagtagttagaagtaaagagaagaacatcacttttcaaaagaaaaagatagtgattaaaagattctgattttggaatatgataccagaaccatctgtggacctcacctggtagataaaatccaatttttcttgccacctctgggtataactcgtgttgatgcaaaatgatatcatataaaagtttcttcttttcattttctgagcaattatttatatgcagggcatttcgtagagattcaaaaaaagaggcgtattcagttactccaaaagtctcacttaatacagttttcaattgtcggagctcgtataaacgcttctgaacatttttcgaagatccgctcttcctagaacatggcacctgtcgttcaaaatcgccaaactgcaaaggttctgaacgatttgatttaattttcaatggacagtttttcgtagataaatggcgcagatttgtaataggtagaattgtgtatgtccctgcgctacccatatgtttaaacagcggtgaagtgaccatttgagccaaaggctgggaatagacacggcatatacattttaacatgccaataagaacattaaagtgaacgcttggaagatttgaaagcccattcttgccagtacgccaataaagtgtgtcgcgcagaatagatcttcatgtaattcctttttcccttttatgcaatctataatgttaatcagcgtagatcactatatacgcttttttttttttttttcagctccgattagagagcaaaagagatgtaacatcgatcctgctataattagaatacaagtgttgatctttaattgtactgtttctgcgaaagctatcgagcatttggctgtattccactgtccattgtatttttaactctcctttttatcattctgaaacatagagctgttttgacaaaattcagttttttctcaattagtgctttcattcatacgttcgttacaagctttgaattttaactttattttcgggcttccacctttgcttcattattttacttcagctctttagctttctgtgacattcaattttattgtatgacagcacgtcgtttgattaatatagttcctaatacgtctaagctagaccctttaaaggaggaggactcaacgcatctgaaacaaaatcaacctaagaagttttccacaaaggagttgatgctttcagaatataccgaacgcaaaagttgcagccttccgttgtctaaatcccgatcaggcagtagtgcatccagtagcactacaggttcgaacggaaagaatattggaacaagacgccctagctccaacctagatttcaatttcgctagccaagatgttgttaaaaatgtattaggtaataataatccacacgtacccacagcgaagtgcattaggccaatatcagatgattctataggtacatcgagcacagagatattttcttcatcgcactcaaatacgacatctgattctttatgtacatcagatataagctcagaagagggtgaaatagcaaacagtaagatggaggataactgcttcttcaaaagtatgagagaagctgaccatagaagcaatattacgcccttaaagaaaagccgaccgggatcaatactacagaaaacacgtacagcaagtagcgctgataaaacaatctgctcaatgagtaccataactacatgcattccatctcgtcaaaattcggtgtcaactcctaaactctccaggacagtagggctgcctggatcgagcaatacaaccaacagtatagccgcatcacaaacttcattcataagcgagaatgactctcctcttaaacatcattgcatgagtaccgcaactatccaagaaccaaaactcatgccgatcacaaaaacgccgtatgtgcattccaatagtacttctgtaatattaccatataaaacaacccaacttactccttctcaacgttaccgtttaaggaaagagcaaaatgaccaatctttgcgtaaagccataaaaatgaaagaaaaattttatgaagatcaagacgttaacttggaacttcaagagggcgatgtcgacggctcgttaatttggaacattccaatggcatctttatcgaccagttcttttttaacattatctaagtttaatagaaaagaaatgagtttagattcagcgcggggggatgaagagatattaatacaggagaacaattgcgaaggcaaacaacactcatcttcggctctctgtgtggacaaaactttccatcaggttcatagtactagaaaacatacatcaaattcaagtaacactttaaaagaatcatgtctggactataaggagcttccgccaacatgcattcctggtatatctcctgtgtctgattcacagtacatccaggatacaatgaaaaatctctcccaaatatacctgcatagttccgaaaaaatctccaaaagtattctttctggtcgttcaagatctgtacagagtttaccactggaatttaaagaagccagtagtcagggaatggaagacctaatgctagtttcagaggacaaactaaaggccgtaagtcatttccgtccgagttggctcccgcccaaggatttcaaagagaggaaattgcaagataaacaaatctacaaaaatatcgacttagcatcaatggaagagttgcaaaaaaataaagaacgtgacgaaaaagccaaaaagaatgagcagaataaggtcaaattccagcatttactggaccgaggcattactcgtaactcgtcattaagtgaattaaagaaaattatttgggaaacacctttgatatctaaagtacggcttcaaatatatagtcaacttctacaaagtgacaattgcttgataacaaaatgttttattgaatcatttgaggaagtaatgcagctactcaacaaaatggattttcccaaagataaagaatttgaaataagacagcttattgaacacgatgtacaggaaaaggttttttataaaaatggaacagataagcaagtggtttctgacttgatgctattactgcaactgaaatctatatctcaacaaggtttggttactggtgatgagatgctattctaccattttttaactgatcaatcttttgggactttgaaggaaacatgggaaatggtcaacttgatacagatgacgtgcttcagtgaaatttgcaaggaaaaatacgattcaagaatattaaatcccagaggaattgttgcccatcttttacgaaaagatgagttcaaaaatgaattcaatggcggatgtttgaatagcaatacatggtggaacatattgcaaagaatggaccataaactttttatgtgggtaatggatgtaattatcgttcataatggccaaaactttgcaaactaccccgtaaaaatggaaatattcaaagacaaagtatgggaatactatagatctaagaaggttattgtaaattataagattttggtttcactaacagttaacgtattgttaaactaccacttcggatatgataatctgaaacatttatcagatttggatgataagcatttttgtattccactgtatacggaggatagtatcgaagaggaaaacctcaataatattttcacaaagtggtggttgcactactaccgaaaattacgttagcgtgtatgtggcacgtactaaaagtttggtgaccagactatctcttcttaagttcattttcactctgaaacttataaatgcatacatacagaaattactttcgattaatataataatatatttttaataaacaatgaactaatgcccttattgtgttttgttattaaccttttcatcaccatttttttttgctagcttctacggcattcacttacgtgctgcaaaatttcgcagcatggaagaaattgttcgcgaagaaaaaagatttcgctcagtgatttgtagtgacaataggtaccagtgttatcactaagtatatcttttagtatatctcttcgcttgaggagggatcaaaaaaaaacaaacgtaaacgtgcacataaacgtcaagtactttttgcaggcattaatattcgtctccaacaaagacaaataaagaagcaatcttttcattaccttaagccagtatctattgatatcaatcgataaggttcgttgttatcggtgctaaaaattataaagtgaaaataagaatcttttcatgtcgtgctcaaacggcatctggcctactgtatctaatttgtgcggatcattatccttcttcacctctgttatttcattgtttccacaaataattgagacttatcgagataaatctgtcgatgggctatcgccatattttttgctggcttggttatgtggggatattacctcgctgataggggcaaagctaacagggcaattgttatttcagatacttttagcaatttattttctattgaatgattcttttgtatgtggtcaatattattactatggcgtgctgcatgaaaataaattggcgactgtcggccatgagcctaaacctcttcttcccgaactggttgaaaatggtgagcttttgagggaggaagaggacatgatacaaggtggtagcagtgcagaaagccctagaagcagtagaagaaggtctgccattacagcagccttggctatagctcatactataagtacagctagcgcatatccgctaaatgtaggctccacccaatcacaagtggggcctcccggagatggtaaaaacagccagctgggtacaattttatcttggattggcgcttccttctacgtaggcgcacgtatcccacaactaatcaagaattacaatagaaagtctacagacggcttatctcccttcctatttgctactacactactctgcaatatcacgtataatttgagcatcttcacaagctgtagatttttagataatcagaacaagagggaattcatcgtgaatgagttgccctttatatttggaagtgctggaacaattgcgtttgatttgatatacttctaccaatactatatcctttatgcaactgatatgcaactacgtgaactggaaagagaactatacagtcctgaagaagacagtgcagcgcaactagtgacagaacgtacatcactgttgtctggtgaaacgcaaacatagttttccctacggagtactaccatttatatttaaacaatgcactctgctcttgggatagtccttgcgagacccttttttcccaataggaatactacgttcgtactctgtgtaaaagtacccaactatagttagcgccagttttacgtaaaaccgtctatgtcttgtttgcattcgcaacagctacaaacacatatagtttgtcacactaatattaataatgaaagttattatgtattcactgtgaacgcttcagtatacagtacggcagtaagtgtttcattctgttctggattaataatctttcactttgcctagccatttgggggcgggttttggctgggttagcttctccttagtcatggagaaaaaaaatcgcccgcaagtatctcgaaaaaggaaaaaatgcccacgcgtataagagtggacccaactgctcgaggtttcaagagcttgtagattaatttctgtagttcagttatacttgcctacaagtgctatacagcaaatagcgaacagtacgaaagtaaacatcatattatcaataatggttcacaacaaagttactatcattggttcaggtccagctgcacacaccgccgccatctatttggccagggcagaaatcaagccaatcctatatgaaggtatgatggcgaacggtattgctgccggtggccagctaaccaccactacagaaatcgaaaacttcccaggtttcccagatggtctaacaggtagcgaactgatggacagaatgagagaacaatccacgaagtttggcactgaaattatcacggaaacagtttccaaagttgatctgtcttccaaaccattcaagctatggaccgaatttaacgaagacgcagaacctgtgacgactgacgctataatcttggccacaggcgcttctgctaagagaatgcatttgccgggcgaggaaacctactggcaaaaaggtatttctgcctgtgccgtgtgtgatggtgccgtccccattttcagaaacaagccattggccgtcattggtggtggtgactctgcatgtgaagaagctcagttcttgaccaagtacggctcaaaagtgtttatgcttgtcagaaaagaccatttgcgtgcttctaccattatgcaaaagcgtgctgagaagaacgaaaaaattgaaatcctttacaacactgttgcgctagaagctaagggggatggtaaattattgaatgccttgaggattaagaacactaaaaagaatgaagaaaccgatttgccagtcagcggtttattttatgcaattggccacactccagcaacaaagattgtcgctggccaagtcgacactgatgaagcgggctacattaaaactgtcccaggcagctcattaacctccgttccaggatttttcgctgctggtgatgttcaggattctaaatacagacaagctattacttctgctggctctggttgtatggccgctttggatgctgagaaatacttaacttccctagaatagatgaattttccattataaaatagatacactcaaatttttgtatacttatccaacaaatcgttactttctccttttctttaataaaaagcaaaccatgaattttatttcttttccccattattagagaaagccaatacataatctacatatattgcgtgtctgaattaaactttttagacacatgacataggccatcggcttactttgtaacgcgtggttgcctatacaccgactattaagttatgactaatattattgctgcgcttccccacctgcatttttcttgtcgtctttgccaaaaggaaaaaaaaacctacgcagattgactctctaaaaaatgattcatgaccagacaattcagtaaacataaactctgttgcattcattcttctggaaaactttataataaagcatctgatattacagctactgacaactaagtgaatttaaactgcaataatcacaagaaaacttagtattcccttatcatgtccgaggcgactttgctatcttacaccaagaaattattggcttctccgccgcaattgagtagcacagacctacacgatgcgttgctggttatattaagtcttttgcaaaaatgtgatacaaatagcgatgagagtctttccatctataccaaagtttcgagttttctcacggccttgagagttactaaacttgatcacaaggctgaatacattgcggaagctgcaaaggctgtgctcagacattccgaccttgttgatctacctttacccaagaaggacgaattacacccggaagatggaccagtaatcttagatattgtaggtactggtggtgacggacagaatacttttaatgtttccacgtctgctgctatcgttgcctccggaattcagggcctaaaaatttgtaagcacggtggtaaagcttctacatccaatagtggagctggtgacctaattggaactttaggctgtgacatgttcaaggttaattcatcgacagtgcccaaactttggcctgataatacgttcatgtttctacttgctcctttttttcatcatggaatgggccacgtttctaagatacgcaaatttcttggaattccgactgttttcaacgtactgggaccacttctacatccagttagccacgtaaacaagagaatattgggcgtttactcaaaggaacttgcgcctgaatatgccaaggcagccgctttggtatatccaggaagcgaaacttttatagtttggggacatgttgggttagacgaagtatcacctataggcaaaactactgtctggcatattgatccgacatcgtccgaacttaaattgaagaccttccaattagaaccttctatgtttggtttagaagaacacgagttgtcgaagtgtgcttcatacggccctaaagagaatgcgagaattctaaaagaagaagtcttgtccggcaagtaccaccttggcgacaataatcctatttatgactacatcttgatgaacaccgccgtgttatattgtttaagccaaggtcaccagaactggaaggaagggatcattaaggcagaagaaagcatacattctggtaatgcattacgttctttagaacactttatagatagtgtgagctccttgtagacattatttcatatgttatacttaaactagatagagacgttttatttgtactaagctgaacattaccctaattacgcgttataagttttaatccttcattttgaaggaaaacaaataaacaaaaagttgatgtggaacaaatacaatgtgcgcggatatcttaagcaacttcgttagttacagtccacacaaagcgaaaaagggctgataaacactcatggacgaagcgtcacatctcccaaatgggagcttgaagaacatggaatttacgcctgtaggatttatcaaatccaagcgaaacaccacgcaaacacaagttgtatcgcctactaaggttccaaatgccaataatggtgatgagaacgaaggccctgttaagaaaaggcagagaagaagcattgatgatacaattgactccacaaggctatttagtgaagcttcacaattcgatgacagctttccagaaattaaggctaacattccgcctagtccaaggtcaggcaatgttgacaaaagtcgcaagagaaatttgattgatgatttgaagaaagatgtgccaatgtctcagcccttgaaagaacaagaagtaagagaacaccaaatgaagaaagagcgatttgaccgtgctttagagagtaaattactaggaaaaagacacataacatacgcaaattctgatatttctaataaggaactttacattaatgaaatcaagagtttgaagcatgaaatcaaagaattaagaaaggaaaaaaacgatactctcaataattatgatacccttgaagaagaaacagatgacttgaagaacagattacaagcgctggaaaaagagctggacgccaaaaataaaattgtgaattcaagaaaagtagatgatcattctggatgcatagaagaacgtgaacaaatggaaagaaagttggctgaattagaaagaaaactgaaaactgtgaaagaccaagtgctagaattagagaataatagtgacgtacaaagtttaaaattgagatctaaggaggatgaattgaagaatttaatgaatgagttgaatgaattgaagagcaatgcagaagaaaaggatacacagttggaattcaagaaaaatgaactgaggaaacgaacaaatgaattaaatgagttgaaaatcaagtctgatgagatggatttacaactaaaacaaaaacaaaatgaatcaaaaagattaaaagatgaattaaatgagcttgaaaccaaattcagcgaaaatggttctcagtcttctgcaaaagaaaatgaattgaaaatgctgaaaaataaaatagccgagctagaggaagagattagcacgaaaaattcacagttaatcgcaaaagaaggtaagttagcatcattaatggctcagctaactcaattggagagtaaacttaatcaaagagactcccagttgggctcaagggaagaagaattgaaaaaaacaaacgataagctacaaaaagatatcaggatagcaagagaggaaacagtttcaaaggatgaacggataattgatcttcaaaaaaaggttaaacagctagaaaatgacttatttgtgataaaaaaaacgcacagtgagtctaaaactattactgataatgaactagaatctaaagataaacttattaaaattttagaaaacgatttaaaggttgcacaagagaagtactctaaaatggaaaaagagctcaaagaaagggaatttaactataaaatttccgaatcaaagttggaagatgaaaagaccacgctaaatgaaaaaatttctaacttagccgcagaaaactcacagctaaaaaataaaatagaggacaattcgactgccactcaccatatgaaagaaaactatgagaagcagttagaatcgctaaggaaagatattgaagagtacaaagaaagcgcaaaagattctgaagacaaaattgaggaactaaaaattaggattgctgaaaattctgctaaagtatcggagaaaagatcaaaggatataaaacaaaaagatgaacagatcagcgacctcactcagaatctaaaactacaagaagatgagataagctcattaaaatccataattgacaggtacaaaaaagatttcaatcaattgaaatctgaacagagtaatatccaacatgacctaaatttacaaatactaaatctggaaaataagttaatagagagcgaggatgaattaaagtcactaagagattctcaaaaaattgaaatagaaaactggaagagaaagtataacaatctttcactggaaaatgacagattgttgacagaaaaagaatccgcatcagacaaagagcgcgagatatccatcttgaacagaaaacttgatgaaatggataaagaaaaatggaacttacaggaatctaaagaaaaatataaacgcgaactacagaaggtgattactgctaatgatcgtttgagaagagagaaagaggagttgaatgaaaacagcaataatattcgtatcatggaagacaagatgactaggataaaaaaaaattatttgagtgaaatcacttctttacaagaggaaaataggagacttgaagaacgcctcatattaaatgagaggcgtaaagacaatgattcaactatgcaattaaatgacatcataagctattataaattgaagtatcactcagaagtaagacacaacaacgatcttaaggtgatcaatgattatttaaacaaggttcttgctttggggacccgtcgtttaagattggacacaaggaaaggtgagcacagtctaaacatttcacttccagacgatgatgaactagatcgtgattactacaatagccatgtttatacaaggtatcatgactatgaatacccgcttagattcaatttaaacagaagaggtccctatttcgaacgccgcttaagcttcaaaacagttgcccttttagtgcttgcttgtgtgaggatgaaaaggattgctttttacaggagatcagacgataacagattgcgaatactaagagatagaattgagagtagcagcgggcgtatatcttggtagtatcgcttactctatcatcatatttctcgtatgtacatcgactcctacgcagactgatcttcaagcgagccaccgtgaatgtggaagcataaacagatgagaaacctttttgtttctgagatcgtgaccttagattgtagtgtgctaatctccctagtattgactactttgcgtttattcatttctttctccaatagaaatacagcataaaacatacgtagggtatatctatgtatgtggtatatttgtattataagttacttagatttactggcgcccttttttaagctattgtaattatttacggcctctgcgattctttccttgaaagtatctgttattatcgccagttggtttaacatttcatagtgattttccaacgtatcgcatttttcaaggagttctttgaacttcgcaatatttttatctatggtgttttcaataataccattcaccatcacttcattttgttttttacatagctccgtagtatccaattgtatactctgtacatagtctctcattttataaagtaagtaatcgtagtcgactgtcaatttatcaattccaagaggatcgtcaccagccgaagccgactctctggaatgacttgagttgtcttgcattctaaataaggccaactaacctagttgaatatactgctaatgaatgctaaaatacacaaatttcatgtaaaaaaaccccgcgaattttgtgttatggttaaaaaataactgtaactgaaattacccaaattggagaaaacttgttaagtccttattttagctactgtggatggctccctctgtggaaatagcagcaattttggccatttaccatgttctagaaaacggctaaaaaacaaataatgaccccgaatattttaaatcgcaaaacctaaaataacctgctatttaactcaataacctatgacagattagcaaaaagccctaaaatttataacttaaaacctaatggtatttttaaaggggtgaatattgcgcataaccatttcaagttaaaaacccttatatcattatataaaaaatatcttaataaagaagcaatttgggacaagtcactacttcaagtataacccagacaagagtcttttaaaatgccacaaagaattgagcttacctccgaaccagtcagaaaaccgcggtctactgagagctcactactcagaaagatacaaagagcgtgtagatccacattgcctgaaccagatttgggcttgaacttagatgtagctgactatatcaactcaaagcaaggagcaacccctagagaggctgtgttagcaattgaaaaattggtcaataatggggacacgcaagcagctgtttttgcactttcactactagacgtgctggtaaaaaattgtggttactctatacatttgcaaatctccaggaaggaattcttaaatgatctagtgaaaagatttccagagcaaccaccattgagatattccaaggtgcaacaaatgattcttgaagccatcgaggaatggtaccaaaccatctgcaaacatgccagctacaaagatgatcttcaatatatcaacgacatgcataaattactgaaatacaagggttatactttcccaaaagttgggagtgaaaacttggcggtgttgagaccgaatgaccaactgaggacacctagtgagctacaggaagaacaggaaagagctcaagctgcaaaactagaagagctgctaagaagcggcaagcccgatgatttgaaagaagctaataaactgatgaaaattatggcgggatttaaggatgacactaaagtagcagtcaaacaagcaattaacaatgaactaaataaactcaaaagaaaagctgatttattcaacgaaatgttgacttcagccgatgagcctgatcttgaaaatgaagctattcaagaattgtatggcgacttaaaatcagcgcagccgaaattcaaaaagcttattgaggaagaacgcgatgacgatgcgcttgttagtaatctatcaaaatttaacgatctagtgatccaattgttaaaaaggtacaagtcaataaaaggtatgaaggaagaagaactaaatgtccccgatacgaatgaaccggcaaaagagcttaatttgatagattttgatgacgatacaacagcaaacactccatctgtgacatctccaagcaaatctttgcaaccttttgacgatcttttaggggattttaataaggtaagtttatcatccccaaagtctcctcaagaaaacgacactgttgttgatatacttggtgacgctcactcaaagtcatctggtatagatttattagattttgattcgcaacctggagaaagtaaaaccgctctgtccgcatattctaactcgattgttctacctaatggtttactaaatagttcaagtaactccaaggaaatcacagctcaatcgcaaagacatatacttaaccaatcggatcacttacgcattgattacgaattaactcgtgagtcgatgacaaaactacgattagttatcttctattcaaacataagcagtgatccaataactaattttgcacttttagtggcatcacctaaaggcacgacattgtctctgcaaccgcaatcgggcaatatgctccaaagtaactccagagatggtatcaaacagattgcttccgtagagggtatatctgttaatttaggtaagcccataaaattgaaatggaaggctaattactgcaccaagggtgattcgaaggaagaatcgggcacgaccagtttgcccacaatataatcaaattcggtagagaagttgaaaaaaaagtagatgccatattatattacagagaacagagtgttacgccaacatactaaaccagagaagtaaaacgttttacttatatataatagtattcgtaaatttataaaaatcaaaaaaccaatataagcctggttaaaaaaaaaaaaagatcagtatcgtaaagtcgtaaagttaggtcattgtttttggaacctttgtaaaatctcctgtggagttggtgactttatccttggagcagaattaatgttagaaatattggaaagagaagattgagatggagatgatttcggtggcggagcttgaagaccctggttgtagttgctgcagttgctgcacatgactggactcctcctgtaactgctgcctttgctgttgaatctggtgctgctttagctgttgctgttgttctctcaaggttctataatagttttttgccgccttaagggccatctcaggaccaatgtctggtttttgctccaacaacttcctcgagtaactttcaatgatatcttgctcagtatactgtttctggtttggtcttggagccgacgcttgcccatttctagccaaatttgaagaagatttgccatttgaaggtattggactttgagctcgggatgaatgtgcctgctgactttgctgttgcctctgttgtaatctatttttcactgttcttctcaattgtatatcccttctcaatgcctcatctctttgggctttcaaaagcgacatttctgctggggtagggaccttcatgtttttacaatctaacggtttccttggctgggttggattgggacgcggcgtattttctctttttttcatacattttctaatcgcctcaaacatgctcgcccaacggagtctcctatgacctctttgtatggattctgtatttacacctaaaggcgatattcttctattctgtctctgctgaaatttatgggcttcaatcaaccactgttgagcactatgtgctctgggacccttgaggtcactaaaattgaatcgttcatttaattgtacaaaacgctcaaaacactgccatggcgttctacgttcaatattcgataaataagaatatgtgaggcgatgtgtcatatgtgcactaatcaattcccaattgtagccatatgtgttaatatttttgaccagttcctgatcgtcctcagacagccatatagtcggtgttctattttgaagatagcgtaatgaaggtactgctggtggtcttaaataatgatttcttctattaccatagaacataccccgccttttgctcaattgtgatattgatggttcttcgtcaatcaattgacgctcaagtaacttataaaatccattatcatccagtgacactaccgatttggaaattggaataaatggtaaagaatcatctttttttggccgttcttcattaataccattatacagcggtaaatcctgtattaatgttttttcaaaagtattgagttcgtcaacaaagattgaaagtttaaatgggggggctagctctttctttgattcttcggtttcgatcaacgctgatgatgcagctacttcatgttgtattaaaacaacttcgcttgaggaggatggcttttttagaagtaacttggtgtcaatagaagatataatttgatcgtgggcaccttcttgagataacaaaccatctgcaaaatcaaaatcactcttagctcctgcttcattctttccattctcatcattatcgttagcagcagcactttctttttcagtaatatcgtcaacgttcgcaataattccaatgtcatccttaccggctatgctaatatcggaatcatttcttgaagtatccgatggtctaccggacttttcagatatgcgcccgtcgtcagataatttattttccttaccaggtagaagtgttttacgttttacacagcatatttccccataggtccagtagtccttgattgcctgtgccattgctgtgcagatagctactttatatttgtggccctctttaaaatctgcttgcatccatttagcttcttctaaaagtatgttttgatgcgtattgtgttgtttccacggatcgatgaatcttttaggttgtcttaaagaccataatccaagtcttcttagttcttctattcgcgagccaacaacagtaattctggcctcgtttaaggcgttgtttataatattagtggtcaaagccttgtgagctctcggtattagattaataagaggcagagtttgtgacatgtacttcaattctgctaagggcaaagcctggggtattttcgatggtatataatcgttcattaataaaaatacggtctctaatgcgtcaacattgttctcgttataatggtctgatgtatctatctctttcgccataatgttctttatcaacggatccttgaattttactgcaggttgcacctcagtgggatctgctggtgggtactcgatgttctcataataagtgtagtgtgctaatgcattaggcactgggggacgcggcgaaataggtaatgaagccatttccgaattattagaagattccaatgactgagattgcatcttctgtcttttttcatgtcgctcttcttcacctcccatagttgactcaagtggccttttgttccacatacctcctgtcttttcagctggcctcaaagaatccatcatattttcacggattgaattatcgtggcttggaacaaaatgactctctgatttgactgatacattttcgctattttctggcagttccctactcattttagaatcggatagcctctggttaggtacatttattaaatttacatccttcaatttcttttttgttatgggagtcgcagctgtatgtaggagcttcggcagtgacgcctcgtcaaaccttataccccttcgtatatcgtttttctttaaaaatgcatctatttccttccgaagtttgttttcatctgttaactctagcagctggttcaagcgggatacgcagtatagttcggtcagttttctatctctttcatcaattaagtcatctgccttaggaaatttacttctatcactgctctggtcctcactgagtgatgctgaattaggcactgctgaacttggacgtgaggacatctttgaggcggaaactgtacttttgattatgatgtctctaaataatctttatattctatctgttcggcggctaacgctacgggtaatagccggcctttgaaaatttcgcggctgcagcaagtacgcaaaaatccttatcccttctaacggttcgaaagggggaagaaccagaaattttgtagttacgccgcaaatacctgtatgccccggctcaaaatgctcaacacttatatgctgactatgttctataaggctcagggtgaatgacctttcttgaattacaatctgatttcactttgcacaatatatactatgtatttttattggagcacacgacattaaaaagatgatcgcccagaaaaattttcagcggtggcggattaatttttactgtcctcggcagcccaaaattatccgtgtaggatgacataaaggctcaatggccgctgctgcttcgtctgttaataatatacaaattgcactaactgtgcagggcagtgatcgcaactatttacttttcgtaaaattaccaagtggaaatttctgtttccaattcatcgatacttttgacaaggccttcgtgatcaagaatcatgtatgagctgataacaccctttttagcttctgattcgaagtgaatcttggcatatttttcaaaaaatcggtcctcctcatgaaagtagtctacttcatcggccttcaccctttttttggatctttcgtctttgtttttattcctcttaccagagtcggtatcatcgtcagtgtcaaaatttacttcatacttcctggtgacgatgatatagaagtcataatgtttgtcatcgccaagtgccgtggcaacatcctccaacgtaatcttgtataaaggtggaacgacttccggtggcatattaatcagcctttcactgagaaccaaagcacaatttttattaccactatcaatcatagttttgaagaaagtggaaagtctcatgtccactttttgtaaatatttgacataatcacttagatgattagctttgaaatcaacgaatgaaagaaaacagtatggatcagattctttgccgtctgttttaattgtggtggttggggaacctaggatcaaatctgccaagctgcttagttgaatcctggtactttcttgaggaccaaataactgacgcagtaaattctttaaagcatgaaaatcaacttctgggttaccaccgaaaaaatcgaagtcaatatttacgatctcttcttctccattttgctcttcttcattttctgaatcggtgctactaatgtcaatttcagactcgtcactgccattttcttcctccacattttttctcttcctattttttaaatcatttaatttgatagcttgaaccatatttgtgagttaattagcaatcctatgaaaatgtgggcctcatgaacaatctaaatgataaaattataaggacataatagataatatattgacaactctttttcagatattttttctacctcaatctcatcgcgaggaatataggcacggaaagagaaactcgtataaagtgaccacggatatcgagaatttgataatttacccttaactgaagttatggcacaatatctgtataaattttaatacataatttgcggcaggaataactgcaacaatactcaaagttattagtgctagccaggcgatattttacattaggctattttattcctttttcatttcaataaaaaaagatagtttttttcgtcaacaatagttcaatgtcacaaattgtatttattacgtaaagtccatctcatgacaggtattcgagtgttaatagtccagcactattagaaaatgcataacatttgcctccagcgctcgtttcattccattttgtacatgttatattaatgccgtgcgcatctattttagctttactaacatcgttgaccgtcagcggatacacttcataagaactatcaattctatatttgtcatcttttatgctataatcccatttccaaagccttaatgacttttgagttgctgaactgtttttaatgccatgcaaaaggcgcctagctgcgttggttataataagacttccatctgctgatccagcaaggaccattggatgtaatcttgacaccccaatggccgttatggtcgtctctcgcgacactaaaggatgaactgcgaaagcagccctagacggcacagcccttaaggaacttgcaccatctgagtaaatatacgagtagatttgaggacaataaacaactggaaccaaattacttcccctgaatctggacaccgtggtctttgttgtagcaatgtcttttggattgaaaatgtaaaagtagccgtccaccgcaactgtactgacgactgtatcttcaaaatctgaataggctgttgaaacggataatatgtaggagtcatggacttggtcataaaatgaaggcacttcaggatcagtcaagtcaaactctgctacaaatccgttcttaaagccacaaacaacagtagtaggagataaaaaatcaaaagtagttatcaaactgtctgccagggataaagtcaaagaaggcttctcacacatcttaaacacgtgaacatcggttgcattatcaataatttccaaaaaatttattgtcccttcctggcttacgaatgataaacagccaaccagatgaggtgcgtgacatccttcgtgccatttaagatcccacacttcaccaaatgagtgtacaatggtttgaacttttacgcaatgtagagtagaagtattcattttgaaaatttgtatacaggaggagtgcttctccttgtcaaacatttctaaatgctcgttcaaaggctcatccatgtactgtgataccgcgacggctaaatattgtatatccttgcctatatcagtattttcctctatattaagccatgcaatatctgttaccaatcctcctacgttgtaaataaagccgcgccttttgccgttagcaagcaccggaaactctattttatcgccagtggatacctctgcatcaacttccccgataagtaacttcaatctcttcgttctcaatttgatcatattctcaaattcagtcttattaatttcatgatatacggttctgtttttatcccctatgactttattatatgcactttcctttttacacggtggatctaagcatacaaaatatggagaatcaggctgaatattcttgaatgggaaatcgaaaacgctagtttcaaagccttccttaacttttgctagcaacaataacttttccttattcagtccataaattctttcaatcttgtctcttgcactcgaaagatcttttaggagcctgatgggacggcccttctgtcctagacttgaccctggggagctgctcttcatatttttagtcgaattcttcttcaaacgaagtttctgtacagtatttcttcttccactgggtctaacagaagctccacttccactactgtttaaatccgccacctcatttttagtagactctaactcattctcaaattctatctcaacattgtcactttcctcaccatcaccttcatcattcaatacaaaatcatcatcgtcggtgtcatcaacattattgacttgtgtagtatttatcacatcatcgcgaccagcatgcactaattgtgcgaaatttgcaactgctttcttagatgcgtttctcctcggccttttactgcctgagttttcagatactgggcttgccaagctatcatagggaacttctgctaccacagattttctaggtcttcctcttttctttgccggtattactgccatcgccacaacttaatatattattacacgtatcgcaatggagcaagttagagaaatttcgctaatggatcaaagagtactagctttagtttttaggacatgaaactgctcttactgagtagaaatcaaagctttaacaactcatccaggctttctcgaacaaaaaatggaatgttgtttatcttcttttgcaacgtagggttttcgaaccgcagctttccgggtgatactgaatcccttctatttccttacagaagacagcaaattttattgtagcatataagaaaagaaatgacaggcagaggagggaccagcatgcctatgaattcccaataccatatatcactttgacagcgtatatcgcaattgaaatagaacaacttttcattattacttcagaattcattttaaagtgattgcgaacacggattatagccctgaacaataaaaggcaagagaaaaaatcatttgttttaggctgttaacagatgaccggtgattccagaagcatcagcgaaccctcaattaatctagatccagataatacaagtttttctgatgaaaacagcgatgacttctttatggacaattcctatgatatagatgaaatcgatcatagcgatgaaagtaataggcaaagtgtcatagttgactctaaagtcacggtaccgccatcaaagcattcaactctaacattatctgatagtgaagatagcgacgcaaaggaacaacatcagtccctgagcagatcatctagtaaaaatgtaaatatagaagatattacggagcccaagccagacaaaccatcgggtcgaactagaggaagatctgtgatgaaagagtctgtagttgaaataaactcatctgaatctgacttagacgaagacaaaaattttcccagatctaggtcaaggtccaggtcaagcataagatcaatatctccagcgggaaaatacaagcgacagaaaagttcattactgtatacctatgatgaaaacgatgactttttcaaggaacttgctaaagaagccaaaaaaagcaccactatttctaaagaatcgacacccgaccagcggaagcgagtttataacatcaaatttctctctaagctagaaggaactataaataaagcggtccaagtgaaggtcctcggaaaatacgaattttcaaaaatacttcctgctgctttggacggattgatgaagtcctataaaattccgaaggtaatgaaagatatatacaaggtagagaatgttactctttattggaacaatgcaaaattactcacttttatgacttgtaattcgctacatatcccacaggattttgaaaatgaagtctctgatatcgatgttactatcgtatccaaagaatacgaaaagaactttgaagcgacactggaatcaaagttaaaggaagaagaagctgctttactcataaaagaacgtcaggagatggaaaggaagttagagaaaaagagaaatgaacaagaagagtccgaatatcgcgagtttgaatccgaattaaaaaacgtagaagaaacacaagaaataaaagaaaatgatacagttatgaatacaaaacttctgcaagagggtggctctttgtcaggaaatagtagtagcatggaagaagttatgagaatcgctctcatgggtcaagataacaaaaaaatctatgtccatgttaggcgttcaacaccattttctaaaattgccgaatattacagaatccagaaacagttaccacaaaagacgagggttaaattactttttgatcatgatgaattggacatgaatgagtgtatagccgatcaggatatggaagatgaagacatggttgatgtcattattgattgagcgcaatttgctaaaaaaggccgaactccggctctttacgtgccacaattattatttactatgggcggcgggtgtgttggtggtgcttgcggtacttgtaaaatattttctgaatataattgaataagaccttttgtgtttaaatcatactcgggtaattctctgttcaaaaagtaggtgctgaccctcttctaccttccgtgaaatattataaaggaatttttccatctctaactcaacatgttaacgcttttctataaaaatttgatcgcctaatgaatacaaaaatctcttcagctttttcgtgctaggtttgaatagtacatctaacgtagaacaactatcaaaacaatttgatatttcctcggctatagttttcttggaacaagaggtaaactacttctctattgttgctacagcagtcaattaaaataattcgtttcatcataatattatgatatcaacgctaaaaggttgtataaattacgagatcagcagaaaataaaattcaagccatcatcctttaaggtgatttgaagggcaagaattggtagtgtaactgcatcaatgagtgattaggtgaaaacgaagaaaaataataaatatggtactgtgcagaattgttgattttcttttttgaactctaaaccatcaagaatggctttcacccactattgttacacatagtactattacttacaccaagatgggatccgacaaatatctcaacactatattggtctacatgctttatcgattgctccttatttacgtatttctataaatagggcgtactttaccaacagtgatcatggatgcaaaaaatgtgaatacatttatatggaaaaaaggtttatatcaatatattttaaagtgattgaaaattactgatgtgtttgatattgttggaataagaatcaaccatcatatacccgactaacgttcatattattagtaaactatcatatacaacctaagaagttgacataaagattgacaagcagttaccatttttagtagaagttgaaaagcaagaattgataaccaaatattgttttccaacaatgcaatcccaaccctatctcaatattcatagaattcacttatttctcagtttaatacatgatgatgcatcttgatattgagaaattatatgtattatccctttttaacctttaaaaggtcacaaataaatagccttgttggcgcaatcggtagcgcgtatgactcttaatcataaggttaggggttcgagccccctacagggctaataacacattcaaaatgttataaattttttttcgggtttgtgtttaaaactaaccttctaaagaaaacaataaaaattatatcaacatttcctcatgtctttgtaacctactagtagggattttgaagggctgaaagcttcttagttctgtcggatccattatattatcattatttacgaaactagtgctatgggtggcgaacgtggtgggcgttaccttttaaagtcctaatggaaacctacctatgcataaagtgaatagagtggcaataaaagtcgaataatagtacaaatacgcaaaaatatgagtacggacgttgctgctgcacaagcccaaagtaaaatagatttaacaaaaaaaaaaaatgaggaaataaataagaagtctctagaggaagacgatgaatttgaagatttccccattgacacatgggccaatggtgaaacaataaaaagcaatgctgtaacgcaaacaaacatatgggaagaaaactgggatgatgttgaagttgacgacgatttcaccaatgaattgaaggccgaattggatagatacaaacgggaaaatcagtgaggggctacataacattatttctaaataacgcaaaaggaaattatacgtctaatgttactttagtacattgttgtcatactagtatattttgcttagatgataaaataaataataaaaagagatacgaaaggctatgcggtagtcgattatatggccttgtagtataataatgatgcacgcaaagtattaaataactcagctgagatttctcatttctttaaatgcagtctcagtttaaaaaattaactatattaagatccgctctttctaccatatgatgcaaatgtgtcctcgaactagtacttgcaatttcaggtaaccccaatcgtttctttattattgtcatttttactatcataataatatcatccgtaataacaattaagtaacaaatcacatccatgtaaccatttaatttgtttcaagtaacattccgagtgaatagctagtcacatacatatatcttacctgccgctccgctgcaaatgactttacttgtttcttgaggatgccagtccacttgagttataggcttgttgcctggaatcttgatgttatttaataagcgcgacgtattccaatcccaagtaaatagtctgctttttgaatcgcctgaacatatgtaacgaccatcaccagaaaaagccaagcttatcccataaccagcagatgaatgccctttaaatatcttttttggatgcctcttatatttgggtttcaaactgaaagaatatattctattatccatgctttgtgcacagaaatagttctgagacggatgtacatttaaaaatggcatagaatgttgagccgtgtcacttatttgttttattggtacattgatctgattttcccaaattcttaccgtcttatcctctgaagaagaaataaacttcgaaccatcgggaaaatacttgagagccagaatgctacttaggtgatgatcatatgtctgcacaagaccttgattttctgaaacacgatcatcataatgtaatattttcgaattcgataaacctacaatgaactcatgtgggttagtgggccgagattcaacatctgcaggcgttgaattaaggtgcaacctggttttcactttaccagtttcagtatcccaaattttaacgcttctatcaaaggaagagctcaaaaaagattgacagtcttcggtgaatcgtaatgctttaataggcttgttatgaccttgaaaatctcgtaggcattcatagtcatggtagaaatcccaaatttttatagtatgatcattaccaccagagagaattaagtgtccagttttaggtaagaatttcagggcagtggttccttctggatgccccggataattacgtataactttttttggtaagtaacaccgaaaggatatcctttcctcacgaagatcaacatcgacgtcatttggtggatataaatatcctctgccttgatagtccttttctgatttaccataaaaatgggagacttcctctacctctatctgttccgaatctaggttgtcctcagccagcgcgtgcacgaagatatcctgatcttctttctgagtttcgctggcttgtgaagtttcatcgtcactacttgaccaactgccccacggcccatctcctttgcgagttttccgtcttctttttagttctgactttgtaaaatgtgattttctcttatgaatattatttgaagaaggttcatacgaagtatcttcatgcaaattaccatttttcttttcatgaacagatttgccttcgtcgaagttcaaatcagagtctgagcttgtgtcataaccgtctactaaacccatttcatctgctcttcaaagtacatgccgtgtttgttgcactatttggccaaaaataaaggaaaaatttcaagattttttttttacctcatctctagcaaggacacagtactccctcgtaaataagacaaaatacaaaaaagaaaattcaaagaaatggtattacaagaaccggtcagagaaacattacgataattgatatcaactacaaatccaatgatgcattctttataattgtacatatctatttgtattcaagtttcatttaaatactatttcattgactgctttaaacctttaccttcttggatgatttgcttttctttttcaacttgtttaccaagttaccaatatcttcattatcatctgcgttattggtcatattgttttcactaccgccaagttttcttttcttattcttaacacgtttactacgttcttttaggattttactcatagcttgtgtacctttgaattcaggctgggtcgggtcgatagcaaaatcgtgatcttcgaagacttctttaaatctaggatcttctaaatcaggtgtaaaggtgtcttcaacaattctctctttcttttgataccggcctttcttgtgtttttctttttctgatcttaagatttcgttcatgttgaaatgtgctttgttatttattgtgccctgagtttcggtatcatcatcatcatccattaaaagctccaattcagcctttgatttggcattcttttcgatctcctcttcatcgttagtatgctttttattaacagatttcaacttgcttttcttatccttctccgactgctgtttcaattcctttactttctgctttcttgctttacgacgttccttctcttttcttcttattttctctatagtcgtttcttctttgtcttccgacgatttctcgtttcctccttccaaggctggagtaaatgtaatttccatatcaacttcttcatcttcatcgttaggggtttctttcttggaattaaacccaaagtcaccaaccaacgactttagtttatttttcgcctcttcatcgacctgcccatccgattcatcactatctgacgccaagtaagccttaaagtccatatcatcaatttccttttgggtaaaggccctcttagcaacttcgaccctatcagctggcgtttcatcccaggtcaatttgacgcttgaatgttgtagagcatctgtgctaaactggtgtggcctatagttcttaggcaatatactgcattcatctcttacatcatcatcaaaagtcataccatcaggaacataccttaaatcgaacatattagcggttgactcatattcggtaccatcacagttatcatagatagctttggaggtggttgtatcactacaataaactattgcgtaataatatcttaatctgtccaactggtattgacgtaaagctctggaatccacgtccttgtcagcatctccctcttcataaagatccttaataccgatgtccatatcagaatcagagtcatcagttttcttctttttggaggttttgttcttatttttcttttggaaaagttcctttggaggtccttcaacttcctcgcgttgcattctttctttaccaaattcacttggataaatagcaactctttcaattttaccacctttaggaacgaaactggaaaaggtaatcatcaaatcctcagatttaacatggtcccaatctaaatttacgacggccaaattcttagagatgtcaccagattctggtttggcattttcaatttctacttcattttcttcttcgctttcaacttcactttctccggacgattcagaatcagaagaagtgaattcatcagaagagctaacataatcatcaggaacttcaccacgggcacggtccactactgttttcgcattaacttctgaatcttcatcattttctgcttccttttcgaaatatttgtcgaaatcttccaattccctgttattctgcgcatttttgatctttctaccatacttgtcaaccttagatttatgctggacctccagatccttcttactgaacctagaatctaacttgatcttatgatctttggttttcgtgttcttaaatttaggatcgctgtagatcccggcaaacctagcatctacaccttccttctttgggttctctccagccatcttcaatttttcttgcaaccttatacgatccgctgaaatgtcttgaaaaatattccggacccacagttatgtgatatttattatttgtaccattatgctaatgatgaatttgagatgagatgagatgaaattttttctgtaactgaaaaatttcggaacgtcaataatgatcggtagcctcatctgggatatttggcccggctcatattgctaatctttggatatagggctattagcagatttcaatcgtcctctcttggcatagtagacacagagttgtatttgcgcttctgagcgatgcttccgagattgttgaagcatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaatgatgataataatatttatagaattgtgtagaattgcagattcccttttatggattcctaaatccttgaggagaacttctagtatattctgtatacctaatattatagcctttatcaacaatggaatcccaacaattatctcaacattcacccatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtacaatatggagacttttactgggtatctaaaaggtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaatagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctaaaccgtaccttattagatgactgccgtactcaactgcaatgtagtggtttaccgaactatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgatacaacaatgtggtatggaagaagttcgtggatggtcatgcgtatttaaaaacagtcaagtgacaatttgtttattcgtagatgatatggtattgtttagcaaaaatctaaattcaaacaaaagaattatagagaagcttaagatgcaatacgacaccaagattataaatctaggcgaaagtgatgaggaaattcaatatgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaatgatgataataatatttatagaattgtgtagaattgcagattcccttttatggattcctaaatccttgaggagaacttctagtatattctgtatacctaatattatagcctttatcaacaatggaatcccaacaattatctcaacattcacatatttctcaaagcatatatgtagtatatatacatatacatatatatatttatataggtttgggaacctatgttttttattgtaccaaacgcatccctcttcaataatcttcgaaaaaaaagtgcacaacaagcgggaaaatctgtgtaaagctgtataagtgatctgtacaaaaactacgaagaaaagaaataataccagggaggaactaccaattgtaaccattaaccttagttatgagatcatctcttctaacccttccaaaagtatgtttccggcaaacgctataaatttttgttaacttgtaaggattcgaagcaaagcacaattttactaacctgttctcaaacatatttttttttcatagtcttttttggggtttatgccgctataccttgcagttgagattgtcttaggtatttccattctaaacaaatgcagtggtgcttatggtattttagcattgttcacgggtcatccgttggattttatgcaatggatagcatatctttggtcggtatttacattaatcgtattctcacaagggctgtatttgattcataagccaaacttgctggtattttcgcaaatctgcgtactttatacaatcgataccatttccacttgtttttttactctatggtttaccacgcaatggttcaccttggaagacactgctaatattgatggaaataatgcactacaaagtaacccaatatcgacaggtaagctgacagaacgtggtattgatataagtaaacaaagtgcaactgaaagctacgaatataccatgactattttaattacgttggtgtcattgatattcaggttctactttaacttcattttggcatcttttgttcaagaattgttacaccaccccaaatatttagttgatagggatgacgtagaacaaaacttgaaaaacaagcctatttggaaaagactgtgggctaagagccaaaaaggttgttataagctatgtaagaatttgttagagtaaatagtaaaataaagccctagcgttatagcgttttacactgatgaagaaatgtttctattctgacatcataaaatcattctcactgatgctattgtcacttttcatcacgtgtgtatttaagtagctcttacgtaattttgaaaaaaaaggaaaaaggaaactatatagcacgcaattccctatttggttgcaattcaattccgtgaaacccttttcttttctaaagtgataataaagtaactttgcaatataatcaggtcgcaaatatacccacagataataatctaccatgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcagggctattaaagattccggagtccctcgtgaggaaatttttattactactaagctttggggtacggaacaacgtgatccggaagctgctctaaacaagtctttgaaaagactaggcttggattatgttgacctatatctgatgcattggccagtgcctttgaaaaccgacagagttactgatggtaacgttctgtgcattccaacattagaagatggcactgttgacatcgatactaaggaatggaattttatcaagacgtgggagttgatgcaagagttgccaaagacgggcaaaactaaagccgttggtgtctctaatttttctattaacaacattaaagaattattagaatctccaaataacaaggtggtaccagctactaatcaaattgaaattcatccattgctaccacaagacgaattgattgccttttgtaaggaaaagggtattgttgttgaagcctactcaccatttgggagtgctaatgctcctttactaaaagagcaagcaattattgatatggctaaaaagcacggcgttgagccagcacagcttattatcagttggagtattcaaagaggctacgttgttctggccaaatcggttaatcctgaaagaattgtatccaattttaagattttcactctgcctgaggatgatttcaagactattagtaacctatccaaagtgcatggtacaaagagagtcgttgatatgaagtggggatccttcccaattttccaatgagcgcgctacattacagttaatgcctccagcaacctgtagtgcttctttaaaccgatccgatacagctgaaacaaacattgattttactaattttcatataatatatacacatatatcgaatgataatgcaaaatataatttaatgaaattggaaatactcggaaaatttatcattatccttttcttcttttgaacgtaaacttcggaccgtcgtcatcgtcgtcgtcgccatcaccgttattagaagccccaaaagagccacgtgatctactagttgcgcttctactgtgtctactttgcttggaacattcttctgacaagtttggccgtaagttcatttccttcaccacaaaaagattacgattattttctctgtgatttagtctatcgcttttatcatcaatatcacccagatcatcttcatcagtaataaaaattttgttttttagtggttgaacgctggctgcagtacctgaacaacgagaaaaagaaaacgaatcttcttctccttcatttgaactatcctcattcgtgaatctgtttagagcttgagatcttttctggatagtgtttgagtttatattatcggacataaatgtattcgatccaaatctttccatctccgtcaaagcaaacatatcttcgttttcttctgtgccccattttgtagttgtatcctttttggagtatttttttaacggaacataatttctagtgattaaaaaggctgcatttcgtataaaatctgagctttgagtgttatttttaccctcttctttgtgcgcctttgattttggacgtaccttgacaaaagtcttgaaattcttgcgtttatgccattctggctccattaggctattttcccatttttcagttgttctgcttgttttgtttccctcactatcaaatgatttcctcagtaaattgttactaggttctacaatagccaaattttttagctgattaatagcttcctcgctcaactcctcatccttcaattcaacaatggttgacttaactcttttgacctctctatttttagtttcttgaatagcttcaacaaatgcgtgcggcgtaccagatttctctttaatagataactcttttacaggtgacttacaattttcttgtaatggagatgaaatttctcgtgaataattagaaagtttacggatgtttttagagggttgctctatattctggtgatgattcaccctaaaattcttagtaacttcagcatcatccatcgaattcacagcagctgtttcatagtcagcggagttcgaagatatggtttgagagccaatccctgctacctccggcaatgacggctgtggtaacttatgtgactgtagcgacttatccaacgaatcctcactcgtgttcacagtacctaagttggggctactgacaattatagcaccagggctactgtgaccacttttctttccaatatcttcagtcggctttagtgcgttttgaagaaatggggcgtgcttttcatctgcctctgcaatgttgggacttgaaatgacagtctttgattctgcgccacaattaagtctcttagcgtcagttaaagacctattttctgatagagtcttagtactcaaacctccagcaaaaaaatcaagactatcgagtggtagtactctacgtctatttaattttcgcttcttcgagactactggactagcttcaacttcaggtgcacgagatgttttcaaaatagtagacattccttcagaaatttgatcaaatttaccgttatctagagttcttgaagatgcacccttcatattaatcactgcgcttaaggtgccatctattattgatgttaacatcgttttgatagtacatagaattttcccattttctttcttatctgtagttgtcaaaatcaggtattctgttgatgcttccaagctgtcaacatatttatataaactatcaatgttgtcaaatgcaaataaatttatattgaacgtccgcaggagagatgatagacgtggttcacttttgatagtagttaacactctgatattattcagcctcataaacttcgaaagcaaaatatttggatcaaaatcaaaaacattgtactccggattactaatcatatcgttccacatttcatcaaattttaaattagttttagatgtgggaagaagagtattacacaattccatcagaaaccgtgattttttcatgggtatagtactaacaagggcatacaattcccgtatgctgttgtcctcgctctttgggtaatcgctaatcatcagattagcgggaatatcattaatagaaatctcagtggagataccatattcagaaagcatcgtcctgaattgtgtcaaatgaggaggaatgttccagacttcatttatccattcgaactctatacgaataggagttgtacccagttcaattattgtggactttaaaacgtccgaggcattaatagtaaatgtttcgccaactttcatgaattttttatttaatgatgtcaatttacccttgttaactaaacacaggctactgtgtttcagatccgaactattattgatttcccatttgaatgtgatatgctgtctggaaatacttttatcatttttaattatcagtgggtttttacttgatctacctatactataagttttgaaggcctgaagacaacatgatataaagctaatagagccatcttccaatgtattctggtatcgtactacccacataaatttatagttatcaccttctcagtattgttgctcatctattacaaaattctgcttatttggtttacgcattgcttttcatagaaaaaaagggctccccatataaatttaagaaaagtactaatatttagcgtagttaacaactttacgaaaatgaaaatgaaatatttctcggaaaagtattatatattatacacgtctctacattccaaataattctacgtttcttggagtagtcttaagtttagtgatgacgatggcgttgttagtatctataccgatttcaaatgattctggttttgtactgctatagtcagagatatttgcctccaccagcttacaaattgcttcaatacaataatgacaccattctaccgcaatttgggcattatagttaagttcctttttatttgtaggtagacctgggtgattgaatttcttacataataagtcccttgagtaccattgaatgtctagtaattgaccgctatgactgtccctcaaacctatcatgatatctgagttcggtaataaacccgtctgtacccacgttttcagaagttttctcctatgattggaattgtgcattgataatggggcaaaacactttagttctgtgtttgtctccgaaacaggattgaatgcatccatttcgcagcgaattaaaagaccaatttcttctgaaagtttactctctacaagagaaaaaataggacatttagagccagttaaatcagcgactttggaattttcggttacccaattttcaaattcaaatcctgaatagcaaattttcttcatatttggatcatttgaataaatgccctctttggacatttgagaatctttttttacatttctgcaaaatgaaagaaggcccgcccccatataagttacaattagtgacgtttgtctatttcgcctgttaaagagatgcatagtcaaatctacgatatgatgtcttgtggttacaacagtaaatttcttgccgatcttaaaatccttaccaggattatctagtatccagttctcaatgtatgaaaaacacggtgatacactatctaattcggatattgtcatgggaacgaactcatcaatattagcaaataagtcatggcctaaatacgggactttccgcttttttgcctcaagaagcgagctttcatacaattcagcaatactttctttcaaatttggtataaggtctttgcgtaggattgtataagcccggccattggtaaacagagctacttctttactttcatgaaatatatctcttggtggtttcgtcaaaaaattgtgcataccagtatgcagaaaagacgtatatgggatacatataagtttcggacgtctctttctataattgtctctctgttgtgaaggcttccttgacgaagatgaatcagaagtagttttctctttgcataatttactttggtgtcctctctcgagattgggcacagtaagcaaatttataccttctaaatctttggccaatccaagaacagcatcttgttcagttgacataactgagtttggctagaaagaaaactttgacataaaatcatcgatacctacaactggcgctgtaatgcaacaatgccattataaaagtaaaacatgctgcgaaaattgcggaaaaactggaaaaatcaatagtggggtaatcccagttagtttgacacaataatttggtgattttggtggaataatcattatttgtgaggatacaccaacgaaaagaaccttttgtggtagtatggtccaacaattgtatttgcaggttggtactaacaacctctataagtagacgatacaagagtgatcatatggtaggacactcagctcagcacagatcaaaaagcagcttagtgtctcacctactaatactacttatctttataacgattattattgaaatgtgtttatataataaaatttttaagaaccaaaggtcggatgatattagagacaactttaacaatggcggacatcgagttcccagtaatgtccaaaatcatggaacccatataagagacgaagcctttatatcaggggtctattattccaattggtccccatacaaaccgaggtttcatttccctcacgacataaacttgaagcaagtgtctcacatttactatgcatttttcaaaataaactctagaactggtggtatagaaaacacggatagttggtctgatctagaaatgaatttgtataaatcgctggcaattaaaaattcagaactaattaaagaaagctcgaacaatagtgtccaaaacatcctacccttaggttgcattggtgaactattttatttgaagaatacctgttctgataagaaatttaaagttatcatgtcaattgggggctggtctgatagtgaaaatttcaaaatcataattaaagatgataaactcttacaaaattttgttgattcgtcggtggaaacaatgttcagattaggatttgatggcattgatctagactgggagttccctggtaacaatgaatcagaacctcgcggatatctgaaactggtcagaatgctgcgattaaaactaaacagcctcgaatcccaaatatttgggaaacgtactgaagatcattttcaattatctattgcggcacctgcattcaaggataaattattttacttgccaatcacagaaattgatcaatatgttgactactggaatatgatgacgtacgattattatggctcgtggtcagaaacaacaggatatcacagcaatctattcagtgagacggaattgaatggaaactttgccatgcattatatgatcgatagatttggcgtcaattctagaaaattagtactgggaatggccgcctacggaagaagtttccatatcaaagataacaaattcgaaccattcaatcaaaatactgtattaattaacaaaattttcaaaggagtgggcaagcccactaaagaaatagataaagctgatggcaaggagggcatctggccttacaaaaatttaccaaagattggtacaatagaacaatacgatccaaaatatgtttcagcatattgctttgatgaaaaaaattcaatatttatcagttatgataacactaaatcagtcaaaactaaggctgaatatgtgacacataacaatttaggcggaggcttttggtgggagtcatgtggtgaagcttatgcaaatgagtcaaggtcgttgataaacgcatttaatgaaggcttgcactttaatgtgtcatcaaaaccatcaatatttcaagatgtgagagttaaaaaatattacttgaataaatatggcgatggcggatttttatctccatatttaaagcatttggattcaagaaagcaatgaatacgaatgtgggcgtatataataacaaaaagtttggtctatttattatccactccgtatatgtatatacatatatacaaatttcgtttattaatgttagaggcttataaaaaaaagcttgacttttccttatgtttcaaagagaggatttttgttgttattttcataatagcatatccattcttgaaaagacttcaaatacaccagcaataacttccaattgtaaatcatgaccaggattgttttctatctcttctttaacttccttgtttaaattaacggagacacctaactcagtttccttttctaaatcaaatgggtattgcgaaaattgtgccattatttcttcagctctactaattgccttatctctcttctcatattccaacgtagtcaggacattctccaatacgtttgccccatatgatccacatattaaagctaaagttctaatgattttgaaagatgttgtctccggaaaatattcattgtaacttaattccatgttcctcgatacgagtacagaaagtactctgcgcttaatggcttctttgcagctggcgtctgcaatggggtgtgtcgccatgtcaaacaaaaagaaatttttcatttctgttctcaatacacctttatcgaccaaaccttttgccaatctttcccttacttgtttcaattgatagttgatctttaaaaggttccatgtttcaccacttaaaagatcaatccagttagaaattgacaaaggttcgtcgtttttcatcaattgcaaagtttcatccagtaaaacttccccagttttggaactgtcaataacttcaatcaacctttcggaaagatcgaaccttttcctggcggaatcatctaagattctgattttacctcttaacgctaattctataattatacaaccacgcaaagcatatgaaatactatcattccaaaacgacaaatatccttctctatctcttaagcccatcaataagacttcttccatcaacgttaacgtagggatattgatgttgtctctcaatttcgattcttctgggtcatatgcaatctttttgtttgttccattgtcatcatccccgtcaacagcaatatttgcgattttgtctcctttggtattgttagcagaagaatgaatggaggaagtatctccagaatccgccctattgactctacgacgttgtaaagtagacatgatttttgctttgtatttttttagatagtttttgtttgaattcttttacgttatcagatcaaaagttgtaatgaaaatatagccaacaatgaaactgctaatttagctctatttgttagcgtggaaatttgaaatttatttttaatctataaatgcagcagcccaaaccgaaacaaaagaataagtgagttgaacagagtaagcaacgggccgatatagaactgaaaaagtcaacgtacccagaaagcaattaactgcgacacaaatagatgtcaatgtccaaaaaggatagataaacaagattacgatccaaggcagggatctaattgtttttaggtaaatgcgtacccattagcctctttttttcagtagtagttgactgctcaggaagtaaaaaaatgagccagaattgatcattaaaaacgaaaaaagggtaactcttcggtgtattttttattattataccatagagtactgaaataatgtttaatttgtcaacgattgaactgatgaactagggatattacctcctgttttataattgttgctagtttaagaatcggcgagagttattttgtgcttgaaaactgtttttgattcaaaaaaaaaatgggagccaagacgtcaaagctttccaaagatgacctgacatgtttgaaacaatccacctattttgatagaagagaaatccagcaatggcataaaggatttttgagggattgccctagtggccaactagctagggaagattttgttaagatatacaaacagttttttccatttggttctcctgaagattttgctaatcacctttttacagtttttgataaagacaacaatggattcatacattttgaagagtttatcacagttttgagtacaacgtccagaggaactttggaggaaaaactgagctgggctttcgaactttatgatttgaaccatgatggatatattacatttgatgaaatgctaaccattgtggcgagtgtttataaaatgatggggtctatggttacacttaatgaggatgaggcaacgcccgaaatgagggtaaagaagatcttcaagttgatggataagaacgaagatggttacattacgctggacgaattcagagaaggttctaaagtcgatccctctattattggtgccttaaacctttacgatggcttaatatgaaaactttgtttttgcttcttatggattggatgttataacagtagaagtaattttaggataattttaaataaaaataatattaaaaataataataatactaataataaatgagaataaaatgttgataaatgagggataaggtctattcatacgtctcatccaagaaggagaaaatatcagaatcttgagttttaaatagattaattattgaaattccaatcgaatatggaatttcttgagtatctctggaatgtgttatcggtttcatttcattggatggtatcaaaaacctttttaacgatctgttatttatatcacgcacgatcacccatcttactttaaaggctttgccatatttttgttcatcttcccatatactggtgtccaaatccattttcaaatccgataccatttctgcaacgccacagaatcttcctgatgtgttgattgaaaaaaataaaaacactttggctcccgaattaagctttttatatgcctcagatagccttttgttgccgaaatgagtagacgaccaaattccgttgtaaaacgaccttttgacatgcttcaaagacgaggactttattacaaaaaatcttgagttttctggaatatttaaccaagggggaataattgcagcactttttcttttattaatttcattgaaagtttgttctttagttgactgctgcaaataccttggtttggataaatattccctgtaataattattattgctattatcagattggttgtagtctctagaaaaggagaaatgccgatttaaatttgagcttgtcaatggaatactattaatctggtgtgtatagttttcatgagtgatctcttctttattttctttcttgttaatatcatttaaagctgtgacatcgttctttagctttgggtttgtttgtacttcaatatgagttctctccaaggaatggatcaacccatctagttctcttaaagagtcttcaattgtcctgtcatttctcttattttctttccattcagagttgaagtaaaaatttgggggacctgtagaccagatttgattcatttttagagcacaacgcaatacttacgtcacaccagccgtagacgatatcttcctttcttaacgaaatagtaacagaggacacaatctgaaaacttcttttgcgattcataaccaacagaaaattttggaggaaaacaatgtagctgtataaatatatatatatatatatgtatgtatacttatttatttatatatatatcacaaaaggctaccaaaaagattagccgccgaggtacatcgtgaggagtgatattctggggaaacgggtagcgatttcgtgtctattttcggtcaccaagtcaacgttacttactgtcgtataaccaaagtacaacaatagcaacagttcctaacattcttccatggatacggaagcattggccaattatttgctacggcagcttagtttagatgcggaggagaataagctagaagatcttctccaacggcaaaatgaagatcaagagtctagtcaagaatataacaagaaattattattggcatgtggatttcaggccattttaagaaaaattctgctggatgctagaacaagggcaactgcagaaggtttgagggaagtatatccttatcatattgaagctgcaacgcaggcttttctggatagtcaatgaaggggtatttttaagcctctttatcatatactcttttgttcgtaatagcaaataactcggtcttattaacgagaaaaagttaaagcatcttctgaatttttattatatacaagttatgtagtaaggcgccacttagcacctagaaaatatgattagcgttccgtaagctggagaccattttcaacgcatcgtgtggtgcatctttattcataacgaaaagtccttgcaactgggcggtacttacggtgatatccaattctttaacactatttacaaactttttgcatatatcagtctcacctgggtaaaatttcataaacattttttctacctggtatggagttgcgttaccaacgaagactttgtagtcaatacgacctggtctcattatagccgcgtctagcttttcaggatgattggtagtcatgaatgtaatagtttcttcagaagatgtgacgccatccagggcattcagtaaaccgctaaatgttacgctagaatgaaaaccttgttcaccagtttgacttcttttgttgaacgccgcgtcaatatcttccagtaatagtatgctcctttctggcatgttattcattaagtggtttaatctgtcatctgttaaattattttcggagaggtttaaaatacaaatgttgtagtctaattcgcccgctaaagcctggataaagctagtcttaccagatccgggagggccatagagtaaatatcccctgcgatatgggatacccctgtcagagtaccatttgccgttcttcataaaatcataaacgtcatcgagaataccctctttgatgccactgtccaaaatgacggagggcagcatccttttagcttttggttgaccaaactttctccattcagggccgaaagaagtgtaaataacagtcttgccctcagtagtcttcagggctatgtctttagcctcgttcaaaatgtcatcgaacaaatgtttgtcacggtacagtgtagttaaggttacggtctcaaatggtgacccgtttgcgatatctatcatttttgcggacctttctcttttaatcaggataaaagcacccttataacgaatccaatgatttcccggacccggaaccagcgaaaattttgtactaactgatccattgtcatgttgtatgtagtttgtcctaacggataagtgtctagataccctttgaggatgtttggccatccatgttagaaaccaggcgtatgatttgtccttcgactgaatctctaagtcgacaatcatttgtcggtataggaccctgctggcttttattataccggatctagctacagctaaacctgtaccaaggatcataagaccaccgccggcggcaaaatagggattgtttgacatagcatcgccaactagttttgaaagtttttcccggactgagtcattaccagtttcatttgttggcggagtaattacaccactcagatttggagtagcctgtttatcatattgtatgtcaatcggcttatccgacatggtagattgagggcacacttcattttttttcaaatcgtcccttggtacgtctactgcgttgcaaatatagaagagtggaaatctttacttatactatttacatcgatttttcggcactctttaagggtaactcaatcgagatataattcgaagagcagtaaactatagctcgaacgtaacagaaagttttttgcttgctatagttcttggccacaacgcctcattcattcatttagaaagtttctcactctttcttcttccttttttagctcattacttgtgaaaatgagctttgttcaaataaggcacatttcttcacaaataaaccgtaagactgtatccattgttggatcggggccttccggcttttatacagcgtaccatttactcaagaagtcaccgattccattaaatgttactatatgggaaaagttacctgttccttttggtttaagtagatatggtgtggcacctgatcatccagaagtcaaaaattgtgaagaaacgtttaccacatgtgcagaagagttttcttcccctacaaaccaaaagcataaattttcctttgttggtggtataaccattggaaaagaaatattgttgaaggaattgctggataatcaagatgctgttattttaagttatggttgtacaggggacagaaagctgaatatccctggcgaactcggaacaaaaggggtgtttagcagtagagaatttgtcaattggtacaatggtcatcctgatttcgcaaaggataagcgatttaccgattttgactggagcaaagtttcgaaagttggtattataggaaacggtaacgttgctcttgatattacgcgtgtacttatttctaatcaaattgatgaaatatgggaaaatacggacatctcatctcttgcactaaatttgctaagaagggcacctgtaaaggacgttaagctaattgcacgaagggatttcgttcattccaaattcaccaacaaagaattaagagaactatgggagttagaaaagtatggcatacgtggccgtattgatcctaaatttttccagaaagaaatgtttgacccatctaagtacgatcgtgcattcaatagacgagtagagatgtgtagtgagtatctcaagccatttaatgaacgttcgaagaaaaactataaaaaggctcctcctccaagcagcggatatgacaaattctgggagttagattatttgaagactcccttgaaaattaatagagacgattttggtgcaatcaactctttgagtttatgtaacaatcgattaaatgaagataacagtttgcaacccttgaaggacgtcaataatattatgacatataaagtggatttgctgattacttcattgggatatgcaggcgttcccatgcctgaattctctaagttgtctattggatttgacaaagatcatatagctaataaacagggtcgtgttttaacttccagcggagaaatattcccacatttatatgcatctggttggatccgtaagggcagccagggcgttattgcctcgacaatgcaagatgcttttgaagttggagacagagtaatacaagacttggtggtcagcggagcgctatccttagagaattctatcgacctctctaatatcaagcacaccacatggaaggattgggaaagaatcaacaagaaggaattgcttcggggcaaaaaggaacacaaaactcggtcaaagtttttaacttttgaagagttgtggaacggtgtagaaggcatataaaatagatcgttaatatatttctaacatcttcttgtaaatgtaaatattttaaaagggttgatcttattacggagagaaccaatcatatcgaaggatttctcaatagtaagtatcccgcgcgtggtcctcggggaaatagaacgagaaacttcaagtacttgatagcaagaaagtgagtgcttggcttccccattttgattataaagaaaggcattattttctagggcaagaaaagacattgttgaaattgttccagaaactttcatttaaagtctttcgtgaaaggagtggacgtcaaaaagaaataatgatttttaaacgtgcagtatctacattgattcctccaaaagttgtgtcttccaagaatataggttcggcaccaaatgccaagcgcattgctaatgttgttcacttttataagtctttgcctcaaggaccagcaccagccatcaaggctaacactagattggccagatacaaagccaagtactttgatggggataatgctagtggtaaaccattgtggcattttgctctaggtataattgcctttggctattccatggaatattattttcatttgagacatcataaaggtgcggaagagcattgaacgtggagttttacttttgtagaaaattctttattttaagcctttttaaaccaaacatgcaaagagaagaaaaactttttggtaaatccaaataatttttgagcgaaattgaaaggagtacataagtgatagaacaaaatttcgttgttttcatatgtctataaggaaactccgtcactttctggctctattcattttttctttagtaaagcataaaaataatgagacggagagtaaactttacaatatatattcataaaaattcattaaaataaaactgttcgatcctattcgatatacacacacacatatatatatatatgtatatagatatgggtgtgtttgtgtgtatccgtgctaaactcgcaaatgcaactttatgtcaaaccaacttgctcattcctacatattaatccattagaggagataagtctatattttttgttcactgatatacatgacctgcgtgcccctcaaaaagacatcactattgaacttatttagaagcttattgttattactctcgtagtgttcagtggcactcgatagtgcaacattcataaaaccatcaatggattccaatcttccgctgtagagtaaacccgaggcaagtttgacgttcactgtcttaccaatgatatcagagagaaactccgtagtaacgctaccctctgtagaagcttttccggacatcactaataatctctgcttgttttgcttatactgtgcaatgccatattttctcgttaatatggcgtcttgtgcattattgaatgggttgctgcgacgttgcttatttggcattgtacacgaacagctgcccccgggtaaaatgttttaataatagaaatatcttacattaaacggctaaaagaaaggcctatagtcgtaataacatttatttcctacacataacccagttaattagccacagtgatattcgatttatgccgcttcaattgtgcttaaatcgttgcatcgcttcagtaacttttaattgtaatgataatgcacgtcaatttagtttcccattcgggtaaacagtatcaggtcgagatatgaaaattggcattccttggagaatgttagccagaagatcgatcagtcgactcccctattgattaacatttcatctttgcatacttggcgtttctaatccttatcttttattaccaagagttcattgtacttttaataaagtgaaatataacgtagcatctcaagagcaaggagattttgatgaaaaaaatatgtcagctgaccctattaatgaccaatcgtctttatgtgtgaggtgcaataaatcaatcgcgtctagccaggtatacgaattagaaagcaaaaaatggcatgaccagtgctttacatgctacaaatgtgacaaaaaattgaacgcagattcagactttttggttctggatataggtacattaatttgttacgactgctcagataaatgtacaaattgtggcgataaaatagacgacacagcaattatactgccttcctcaaatgaggcctattgttccaattgtttcagatgctgtcggtgcagcaaccgtataaagaacttaaagtatgcaaagacaaaacgaggactatgttgtatggattgtcacgagaaattgttgagaaaaaaacaactattactggaaaatcaaacaaaaaattcatcgaaagaagattttcccataaaacttcctgaaagatcagtcaaaaggcccttgtcacccaccagaataaatggtaagtcagatgtcagtacaaacaacaccgcaataagtaagaaccttgtaagctcgaatgaggatcaacagctcactccacaagttttagtatcacaagaaagagatgaatcatcgttgaatgacaataatgataatgataacagcaaggacagggaggaaacatcttctcacgcaaggacggtttctattgacgacattctgaactctactttggaacacgatagtaatagcattgaagagcagagtttggtggataatgaggactacatcaacaaaatgggtgaagacgtaacctataggctattaaaaccacaaagagcaaatcgagattccatagtggtaaaggatccgaggatcccaaattcgaactcgaacgcgaatagattcttttcaatttatgataaagaagagacagacaaagatgatacagacaacaaagagaatgaaatcatcgtcaacacacccagaaatagcactgataaaattacaagtcctttgaacagccctatggctgtacaaatgaacgaagaggtcgaacctccgcatggactggcattaactttatcagaagctacgaaagaaaataacaaatcatctcaaggtattcaaacgtcaacttccaaatctatgaatcatgtctccccgattacaagaaccgataccgtagaaatgaaaacatcaacctcttcatcgacattacgtttgtctgataatggaagtttcagcaggcctcaaacagcagataacttattgccgcataaaaaagtagcaccctctccaaacaaaaaactttcaagatcgttttctttgaagtccaaaaattttgttcacaacctgaaaagtaaaacttcggaaatgctggacccaaagcatccccatcacagcacttctatacaggaatcagacactcattctggctggggtgtttcctctactcatacaaatataagaaaatcaaaagccaaaaaaaatcctgtatcaagaggccaaagtgacagtacaatatacaatactctaccacaacatggaaattttacagtaccggagtttaatcacaaaaaagcgcaaagcagccttggcagtatatccaaaaagcaaaattctaatgatacagccactaatagacgcataaatggttcatttacaagttcaagctcggggcatcatatagcaatgttccgtacgccgcctttggaatcagggccattatttaagaggccatctctgtcatctgagtccgcacaccacagatcttctagcttacagacgtctagatccactaatgcattgttggaagacgattccacgaaagtggatgctactgatgaaagcgctacaagcttggaaaaggacttttactttactgagttgactttaaggaagttaaaattagatgtgagggaactagaaggtacgaagaaaaaattattacaagatgttgaaaatctaagattagcgaaagagaggctgttaaatgatgttgacaatttaacaagagaaaaggataagcaatctgcatcttcccgggagtccttagaacaaaaagaaaacattgcaacatcaatcactgtaaagtcaccaagttcaaattccgacagaaaagggagcatatctaatgccagtcctaaaccacgcttctggaaaatattttcaagtgctaaggatcaccaggtaggcgatctagaatcacagcaacgttcgccaaattcatcttcaggcggaacgacaaatatagcacagaaagaaatatcatcaccgaaattaattcgagtacacgatgagcttccttctccaggcaaagtaccactgtcgccaagtccaaagagattagattatacgcctgatggttcccatttatatggatcttcgctacaagctcgatgtgcgtatgaaaaaagtactgttccaataattatcaggtgctgcattgatcgcattgaaaaagatgatataggcctgaacatggaaggcttatacagaaagtcgggctcacagactttggttgaggagatcgaaaatgaattcgctcagaataattcgttgcatagtgatacattaagtcccaaactgaatgctttactgaatcaagatattcatgcagtggctagcgtattaaaacgatatttgagaaaactaccagatccagttttatcattttccatatacgatgccttgatagatctagttagaaataaccaactaattgagaggctaccattaaacaacgacaagtttttggattcaccacaaaaagtgactatttatgaaatggtgctcaaaagcctacttgaaattttcaaaattttacccgtagagcatcaggaagtattgaaagtattggcagcacatatcggcaaagttcgaaggtgcagtgaaagaaatttaatgaacttacataacttgtcgttggtctttgcaccgagtcttatccacgattttgacggcgagaaagatattgtggacatgaaggagaggaattatatcgtggaatttatacttggaaactatagagacatatttaagcaagcataatacagatttgcaaaagttaaataaacataggatagattaaataagaaatcatatgaaaaaagaataaagtaagaaaatagttcaatgtatattcgtcagttcagggtgtgaaaaggtggcaatttttttgtttccgacccgtaacaagtgttcaatggtggtgaagtcttttcttggcaaatttctatacttcccaaattcttcatgaatataattcacaaaattaacttggttttcctttggttttgtatgagccgttcgtatggaagccctatacaggtgtaagacttctttttgtaacccacttaatctcttaggcatgctcttggtattgcgtctcctcttcttcttgtgtgtttaagctacattatctttgttaagaataatttggcgaacccctttttttcttcggctttgcaaggttaattaattaacatctaccagttttactacattttagattggttcgtccaccgaaatttaaaaaagcaggattgaaagcgtacaacaacgtcttagcgaaaaagataatccaaaattcgatgcttgtacacctcatgtagcttccttattaacatttggtagtaggcttaggctattttttgaaaaagccgtcatatattactttgagcctttgcgaatcctctccaaagtgtcggttacctaccgggagggataaccgcggatagccgtcatttaccgaaaattgccgaggtcatgctgagcatttgtcgtacttttgtgcggcggagctttgataccttcggtaagtgtcggtatgtaataggttagtggcatcttatttattgtgttgagtaaagtttaagatataaactgggctagtttgcatcgtcactacagcggcagctcactttcattttttttctgcgtttattaatactacataaaatctgatataaaacatatttaactgatcaaccctctcaacttgatactcaaaacaagttgacgcgacttctgtaaagtttatttacaagataacaaagaaactcccttaagcatggcacctgttacaattgaaaagttcgtaaatcaagaagaacgacaccttgtttccaaccgatcagcaacaattccgtttggtgaatacatatttaaaagattgttgtccatcgatacgaaatcagttttcggtgttcctggtgacttcaacttatctctattagaatatctctattcacctagtgttgaatcagctggcctaagatgggtcggcacgtgtaatgaactgaacgccgcttatgcggccgacggatattcccgttactctaataagattggctgtttaataaccacgtatggcgttggtgaattaagcgccttgaacggtatagccggttcgttcgctgaaaatgtcaaagttttgcacattgttggtgtggccaagtccatagattcgcgttcaagtaactttagtgatcggaacctacatcatttggtcccacagctacatgattcaaattttaaagggccaaatcataaagtatatcatgatatggtaaaagatagagtcgcttgctcggtagcctacttggaggatattgaaactgcatgtgaccaagtcgataatgttatccgcgatatttacaagtattctaaacctggttatatttttgttcctgcagattttgcggatatgtctgttacatgtgataatttggttaatgttccacgtatatctcaacaagattgtatagtatacccttctgaaaaccaattgtctgacataatcaacaagattactagttggatatattccagtaaaacacctgcgatccttggagacgtactgactgataggtatggtgtgagtaactttttgaacaagcttatctgcaaaactgggatttggaatttttccactgttatgggaaaatctgtaattgatgagtcaaacccaacttatatgggtcaatataatggtaaagaaggtttaaaacaagtctatgaacattttgaactgtgcgacttggtcttgcattttggagtcgacatcaatgaaattaataatgggcattatacttttacttataaaccaaatgctaaaatcattcaatttcatccgaattatattcgccttgtggacactaggcagggcaatgagcaaatgttcaaaggaatcaattttgcccctattttaaaagaactatacaagcgcattgacgtttctaaactttctttgcaatatgattcaaatgtaactcaatatacgaacgaaacaatgcggttagaagatcctaccaatggacaatcaagcattattacacaagttcacttacaaaagacgatgcctaaatttttgaaccctggtgatgttgtcgtttgtgaaacaggctcttttcaattctctgttcgtgatttcgcgtttccttcgcaattaaaatatatatcgcaaggatttttcctttccattggcatggcccttcctgccgccctaggtgttggaattgccatgcaagaccactcaaacgctcacatcaatggtggcaacgtaaaagaggactataagccaagattaattttgtttgaaggtgacggtgcagcacagatgacaatccaagaactgagcaccattctgaagtgcaatattccactagaagttatcatttggaacaataacggctacactattgaaagagccatcatgggccctaccaggtcgtataacgacgttatgtcttggaaatggaccaaactatttgaagcattcggagacttcgacggaaagtatactaatagcactctcattcaatgtccctctaaattagcactgaaattggaggagcttaagaattcaaacaaaagaagcgggatagaacttttagaagtcaaattaggcgaattggatttccccgaacagctaaagtgcatggttgaagcagcggcacttaaaagaaataaaaaatagaaacttgtgggcgcaattataaaacactgctaccaattgttcgttttctgttcattaacacataaaaaacccttatgtaactatatttacaaagtaaatacgtatattaaagctattttaccactaccacagagttctttgtccagttgctagtattttttttttcgcgacgaggcaggggcggggagacgtgttgtttttccacggctttcggctcaccacttgaagaactataaaaggccgccaaatttatcctttttcacttcttccgttcgcttttttctgtcattcctatcgtgtgtttagtagtaggtttttttgttagaagaagttttatccgaaaactatcgaagacaaatagataaaaaaatctccctcgttctatttgaaactttaagaaatccatattaagaaaatacctacatctgctaaatgtctgctaacttagataaatccttagacgaaatcattggctctaacaaagcaggaagtaatagagcccgtgtcggtggtactcgtggtaacggtccaagaagagttggtaagcaagttggtagccaacgtaggagccttccaaacagaagaggccctatcagaaaaaatactagggcacctccaaacgcagtcgctagagttgccaagctcttggacaccactagagaggtcaaggtcaacgtcgaaggtttgccaagggacattaagcaggatgctgtaagagtatgttaatacgtgaaatgagagctatttgtttagttactcgcatcgtctcgtgtggatacgagaaatattctttgtaaggaaggatatggcacacgcttttgatcaagaattctctttttagagatgaagaaagagtccgaaatacttcgctagagaaaatacaaaaagagtatcgttttcataagccaaccataccaatttttttcaatacttcaaatcatggcctataaggttggaattaccagctaccactgagaatgggtttgttcttattggctgggttaactcaaatcaatctgactatctgctaatctgtcaatcttacatttttaagctggcgtattgtgtcgcctcgaccgtgatagttagttcctatttttaataagcgtatcatccaatactgaagttgtggaaggatcaattaattttgtatcctttcaagagggagtagctttcagtttcgaatggcaccattttcaaaaaatagctatgggaaacatgtctttcatgaacgttcgaaaagatatgagtgcatcgcttcatttttttattatgatagttacaaaaatatttgatttgagacacctaatgaaaccaaagaggaactcacccatcgtggtacatgtttatttgagggtttatttttcctacgcaatggtatacttttaatactctcaactccttgattgtttgtgtattgtcccttccttctttgattttatatcatagagatatatgactaacttttttttttttattataggaattttttgcatctcaagtaggtggtgttcaaagagttttgttgagttataacgaaaggggccaatctactggtatggctaacatcacattcaaaaacggtgaattggccagaagggctgttgaaagatttaacggctctccaatcgatggaggcagatcaagattgagacttaacctaatcgttgatccaaaccaacgcccagtcaaaagtttagccgacaggatcaaggctatgccacaaaaaggcggaaacgctccaagaccagtaaagaggggtccaaatagaaaagctgctatggcaaaatcccaaaacaaaccaaagagagaaaagcctgctaagaaaagtcttgaagatctggacaaggaaatggcggactatttcgaaaagaaataattaattgtcaattttttgtttgatttaatttggttttattaaatttaatttttccgagtttcattatgtattagtttccagaaaatttaaaggattaaaaaatgtattaataaaactttgatatgtttatgtaataatatttaccaccgccactaggtgacgctaacctactcatcggtgacggcttttctcacttttaaagtttattcggcatatttgactcataatatgtcactatttacagtgcgatgaatatatatatacataatactgcattgaaaaaatggataggttgattaaacgtgtgttactcgtttctcctcctatctaaaaaacctaatttgtcacctctttttcttgttacagcactaagcccgctaccttcatatttactctttcttactaattgatggtcctcagagcaatcaatgttgtctcctccatctttaggtatggggaaccctggtttgacttgagcaaggttatcataatagtttttttcattcacttcaccattgtttccccgcgcctttggtataaatttagcatctcttctagctttcactatggtcttgaccacataaatagacgcaatcccggctgcagaaatgtatagtaaattcttactgttgaaatcgcattggtagtgttttcctactttcgtcttcactttggttatatatatggtgcaatcaaactctgcttcaagggataggccaataaggaaataaccaaaaaagaagtccgggaaatagaaaaagatatccaatgttagtttaggctttacgaatagatgtttccctatttcttttacacataccctatattttgaaatggatttgacattgtatacttagtacggctcaaagaatgaaatattactatatttatctcttcatctgccttgatttttttatatgcaagcaggacgctcgggtttgtaaggaggaagattgaaaaggatgtcttcaactaaaaggcgaagaaggaagcgacacatttgtgatgctttgaggtcagtaatgtaatatatatatatatatatatatatatatattatatagtgtaactgctcttatttatcttgtctattcgaacccaacaaaaaaggctgcagtgggaatctgttcatgtggctgtatcacaaccaagggctaccgtttaagaatactggagagctcttgtcgtctctaattttatgatcacgtgcccattctagtcattacgcaggtaatgcgaaaattacagtatggatcgtgtaaagttaccaagcagaaaaattgtaataattttctttttccaaattttctcggtatctgaaatttttcatttaagagatgatatttggacttactctaaactattactttacgtatctttgatttaacttccagttacagatcgttaaggaatagtccgcgaatttattaccgcttaaactgattatttcaaatatagaaagtaatatctattaatcaacaacagaaatgaaatacttagctgcttacttattattggttcaaggtggtaacgctgccccatccgccgctgacatcaaggccgtcgtcgaatctgtcggtgctgaagtcgatgaagccagaatcaacgaattgttgtcctctttggaaggtaagggctctttggaagaaatcatcgctgaaggtcaaaagaagttcgctactgttccaactggtggtgcttcttctgctgctgccggtgctgccggtgctgctgccggtggtgatgctgctgaagaagaaaaggaagaagaagctaaggaagaatctgatgatgacatgggttttggtttattcgattaaggaatttaattaataaacaattttcttgttttccttcattttacaaaatctggtgtaaatcctcgattccattgtgatttaaaaataattaattactgtataagattctatatagacaattaattgaaaatagtattacttctttaactcgcttaggattttttttattttttctctcttttccggagaattgccaaatgttttcacggcctcttccaataatagcttcatttcttccaacgcaactactagtttcccattgtaagtggcgaagtactcgctgatatcatcatcttcagaagcttctttaatggaagttgttaaagaatttatagaatttgtttggctcagaatatctgataatttactttcgcctatttggagagcctgacatttcagtattaaatctttccttaaattactatactcgcttagaactttgagatcattttccacttcaacttcctcttcgtctgctacttccatctgcggcagcttcaacacatcttcaattaatctctctatcgatgtactctgaggttcaccctcaactctatttcttagttcacttccaagagagtactttggtatgtctccaacaagttccattatctgctgcgattgactggctctcaattcagactcgttatcgtatatctctttgctcagtaagtcttgttttcccctgctcatggcatcctttctcttttcaattacttgagcctttagtaatctgcacacttcatttggtaattcgcctgctaggtcatccatgaggtagtcatcactcgacagcagtgcggtcaattcattttctataaaattggatatgctattatatgtgtctgtcatcttattcctacaatctattgttgctttagtttctgtgcacatttaccaaaaatatttcttcgcatgtagatttacctcttttcccctgtgacgcgtcatcgtttttatatcacctttgaacaaagcaatatatctgtactcaaaaggtacaaacgaaagttttgttcacgagaaagagatattttacatgcgaattaaatcttgattgcctgaattcttcactattttatgatttttcccttccttcttgaaatttgatttatatttagtccaaatattacagaaaaaaaaaaaaaagatgcctaagccttgggtcttatttcgaacaaatccatccatcggtaacaattcaaaaaaagaatatttcgtctcgaacaatttgctaagtattgtgggtaaatgatatataaatttttataaaaactcttggccaagaaaaaaaaaaaagactatgtctaaacgtaacgttatcattattattaaatcattttaatgttttataagttttgtttttcatttcataccctttaaggagcatttggcattgtgtgcgccctgaaggctaaataagaatttgaaggactcaccacagaacagtatagcgaataccaaccgcagcaactacttaaaattccaaaatagccaccggccattttgagattgttgttgtcaatgaaggtgccgatacacagtagtaggaaggtaagatccaaaaacgtcaatagtaagaacaaaccccacgtgctcttcaatgtacacatcaacatcaagaaggtgaaaacggtccagcccgcaaggaagaacccaatgacattgttcaacattgtgggatcggtatagccgctgaccaaattatcagtatctgttagcccataaccgtagcagatccagaacccgccgaaagaactgaacacagtcatggcgtatgtgtccccaatgacaaaacacaataacccggcaaacaattcaatggcaccaccaaaaaacataaacaaacttagcgcccatttaccatcagtgacgccgcgaacgttcgcattaattagcgacagaactagacatgacagagaaaacgatgcgagacccaaaggaaccggattagcgaactggtgcggagtatactttgcacagtttccttcctccccatcccctctgtctagtgcattgagcaaatctctgcgcctgtaggtggaggatcctagagtaatgaagtctctgtcggagtatatctcttgaatattagggaagccctgcgaaacgcctgcaatcgaaccctgctgggggagcgtctcaatattttctagagtgttcacacccttttccaaatcctgtggagaagaagcagacgatgtcattttaaccagtatttttattttttattcttactaaatctttctgggaatgtattcagttatatgtgacccaactgtttataaaactgggggaatattaggcaatcaagcgaagctcatcgatgagtattcaatttgctaaaaagttgttttatttaaatattccttctgagtcacggtcatcgtgaatagcgttaaaattctcaaatccattggtgtttccattaggccctgagcggttccccaagaaaaaaaaaaacagtagaaaaaaatgatgcttcttcctaacgctattgtagtgcaggttctgccgtgtgccaagttggagcagcgcctgctgagactcttccgtatggttcttgctcttctcaggaccagcggcggcagttccggtttttttcggcgtcttttgtctggcacacaatgggcgatggagagggaaaaccggaggatatgccagctgcggtgagattatggttggagttatgtttgtagccggcggtgcggcaataggagaggggaggggaaggggaggggaaaaggtaatggctgacgaagtatagagatggcaatcacaagccaaatattggagattacatgcaagaatgctactgttatacaaaagggtgaaaattgagacccaaattccttccttttttttcttttttttttaccagaagaattacgtacaaaagtacctactatttcaaagcaagaaatgagatgcctattgtggttatatacagaatagatgataaatgggttttccgtgcaaaacgatatggagaattcaaaatgggtgcgaaatacctggaacgtaagcgttctgagaaatacacagacgcattaacctgacaaaaacacaactagtttgggaaagggatttggtctttcctctcgggtctctcgtgtggttcctttctttctcagatctccctgcacactgggctgttgtcctccaggttatggtttgttctcttcaggtattacaatgcagtaggcttttggagtgagcaaaacgaagagagaaaaaaattttttcttaaaagttttttttcattttgtgagcttattcttcttttctatatattcttgatatcttagattatacatattattctcttacatttcacgattgcccttttggtgtttagcattcagactcaaagaccacaaacacaaactataacataattgcaagatggttgctttcactgttgaccaaatgcgttctttaatggacaaagttaccaatgtgcgtaacatgtccgttattgctcacgtcgatcatggtaagtccactttgaccgattccttggtccaaagagccggtattatttccgctgctaaggctggtgaagctcgtttcaccgataccagaaaggatgaacaagaaagaggtatcactatcaagtctaccgctatttctctatactctgaaatgtctgacgaagatgtcaaggaaatcaagcaaaagaccgacggtaactccttcttgatcaacttgatcgactctccaggtcacgttgacttctcctctgaagttactgccgctttacgtgtcactgacggtgctttggttgtcgtcgacaccattgaaggtgtctgtgtccaaaccgaaactgttttgagacaagctttgggtgagagaatcaagcctgttgttgttatcaacaaggtcgacagagctttgttggaattgcaagtttctaaggaagatttataccaaacctttgccagaactgttgaatccgttaacgtcatcgtttccacctacgccgatgaagttttgggtgatgtccaagtttacccagccagaggtaccgttgccttcggttccggtttgcacggttgggctttcactatccgtcaattcgccaccagatatgctaagaaattcggtgtcgacaaggccaagatgatggacagattatggggtgactctttcttcaacccaaagaccaagaagtggaccaacaaggacactgatgctgaaggtaagccattggaaagagctttcaacatgttcatcttggacccaatcttcagattattcactgctatcatgaacttcaagaaagatgaaattccagttttgctagaaaagttggaaattgtcttgaagggtgacgaaaaggacttggaaggtaaggccttgttgaaggttgttatgagaaagttcttgccagctgccgatgccttattggaaatgattgtcttgcacttgccatctccagtcactgctcaagcctacagagctgaacaattatacgaaggtccagctgacgatgccaactgtattgctatcaagaactgtgatccaaaggctgatttgatgttgtacgtctccaagatggtgccaacctctgataagggtagattctacgccttcggtagagtttttgccggtactgttaagtccggtcaaaaggtcagaatccaaggtccaaactacgttccaggtaagaaggacgatttgttcatcaaggccattcaaagagttgttttgatgatgggtagatttgtcgaaccaatcgatgactgtccagccggtaacattatcggtttagtcggtatcgatcaattcttgttgaagactggtactttgaccaccagtgaaactgctcacaacatgaaggtcatgaaattctctgtctctccagttgtgcaagtcgctgtcgaagtcaagaacgctaacgacttaccaaaattggtcgaaggtttgaagagattgtccaagtctgatccatgtgtcttgacctatatgtctgaatccggtgaacatatcgttgctggtaccggtgaattgcatttggaaatttgtttgcaagatttggaacacgaccacgctggtgttccattgaagatctccccaccagttgtcgcttacagagaaactgttgaaagtgaatcttctcaaactgctttgtccaagtctccaaacaagcataacagaatctacttgaaggctgaaccaattgacgaagaagtctctttggctattgaaaacggtatcatcaacccaagagatgatttcaaggccagagctagaatcatggctgacgactacggttgggatgtcaccgatgccagaaagatctggtgtttcggtccagacggtaacggtccaaacttggttattgaccaaactaaggctgtccaatacttgcacgaaatcaaggattccgttgttgctgctttccaatgggctaccaaggaaggtccaattttcggtgaagaaatgagatctgtcagagttaacattttggatgttactttacatgccgatgctatccacagaggtggtggtcaaatcatcccaaccatgagaagagctacttacgctggtttcttgttggctgatccaaagatccaagaaccagttttcttggtcgaaattcaatgtccagaacaagccgtcggtggtatctactccgtcttaaacaagaagagaggtcaagtcgtttctgaagaacaaagaccaggtactccattgtttaccgtcaaggcctacttgccagttaacgaatctttcggtttcactggtgaattgagacaagctactggtggtcaagctttcccacaaatggttttcgaccattggtccactttaggttctgacccattggacccaacctctaaggctggtgaaattgttcttgctgctcgtaagagacacggtatgaaggaagaagttccaggctggcaagaatattacgacaaattgtaagaatggttaaacaatttttaattatttaactttttcagtttttgtcgtaatgtattgggcaccttttatgtccttttgacttttttgtagtttattctcacgtatacttaccatctatagtgttatttcatatttaatcatatttccatattagatatctgccttcccctgtataatagttactatgatttatcttgctttgcctattcgcgtcatcaacttcttttcttaccgatcgcggtaatgccctttaagagtggcatcaacattggcgtaaacaaagtttcaaaggattgatacgaacacacattcctagcatgaaagcatggaactctcatcaaacttaaaagacctatatattgaatggttacaagaattagttgacggattaacccctaaacaagaacaactcaaaatagcctatgaaaaagcaaaaaggaatttacaaaatgctgaaggttcattttattatcctacagatctaaagaaagttaagggaattggcaatacaataataaagagattagatacgaaattacggaactattgcaaaattcaccacatatctcccgttgaggctccttccttaactcagacaagtagcaccagaccaccaaagaggactactacagctttgcgtagcatagtaaactcatgcgaaaatgataagaatgaagctcccgaagagaagggaactaaaaagagaaaaactaggaagtatatacccaaaaaaagatctggaggctacgctatccttctttccttactcgagcttaatgccattcctcgaggcgttagtaaagagcaaatcatcgaggttgcaggaaaatacagtgaccattgtatgactccaaatttctccacaaaagaattctacggtgcttggtcgtctattgctgcacttaaaaaacattcgttggttcttgaggaaggtagaccaaaacggtattcgctaacagaggaaggtgtagaactaacaaagagcttaaagacggcagacggaatctcttttccaaaagaaaatgaagaacctaacgagtattccgtaaccaggaatgaaagtagtgaattcacagcaaatctgactgacctccgtggtgaatatggtaaggaagaagagccctgcgatataaataacacttcattcatgctggatataacttttcaagatttgagcacgccgcaaaggctgcagaacaatgtatttaaaaatgatagactgaatagccaaactaatatatcttctcataaattggaagaggtctctgatgatcaaacagtacctgattccgcattaaaggctaaaagcacaataaagaggagaaggtacaacggagtaagttacgaattgtggtgtagtggtgatttcgaagttttcccaattattgatcacagagaaataaagtcacaatctgatcgtgagtttttttcaagggcatttgaaagaaaaggtatgaagtcagagataaggcaactcgctttgggtgatattatatgggttgccaagaataaaaataccgggttgcagtgtgtgctcaacaccatagttgaaagaaaaaggctagacgatttagctttaagtataagggataacaggtttatggagcaaaaaaataggttagagaaatctggctgtgaacacaaatactatctcattgaggagactatgagtggcaacattggaaatatgaatgaggccctaaagaccgcgctttgggtcattttagtgtattacaaattctccatgataagaacttgcaattcggatgaaactgtggaaaagatacatgcgttgcatactgtaatttctcatcactattctcaaaaagatctcatagttatatttccaagtgaccttaaaagcaaggacgattataaaaaggtgcttctacagtttcgtcgagaattcgaacgaaaaggcggtattgaatgctgtcataatcttgaatgctttcaagaactaatgggaaaaggcgatctaaagacggttggtgagctaactatacatgttttaatgcttgttaaaggtatatctttagaaaaagcagtagccatccaagaaatatttcctaccctgaataaaatactaatggcatataaaacgtgctcctcggaagaagaggctaaattgttgatgtttaatgtactgggagatgcacctggtgcgaagaaaattactaaatctctttcagaaaagatatatgatgcttttggtaaactttagcaatttgaaatatagtcatccctgcaaggttttataaagaaaaaagtgatgatattcttttaactaatatatacatatataagaaaagaagccttaatttctcacggacaaatataccagaagcatatctgaaagccgccccaatgcattatgatgccacttgacaactcatcaatggtaggtacgaaagacataatgaacatcaattccattatcaaaaacccttccaacctcttccagtgacaaacctttgacttctggataccaaaaatatacgaaaaaccaggcacaaactgtgaaaaaagcaaaaatgagcattgtattttcatcaccaatggtgttaatagtgctcagatatgtcattgaaacaaatgcattggtcaaccaatttgtgcaggctatacatgatgccccaaatgatctcctgttcaaggggagaaattccacacaggtccatggaacgctgcccatcgcagaagcatatgctgcaacataaattacaacagaaattaaaagtaaattgacttggtcatgaccgaaacctacactgcaaagaagtaacccaacagtcataatcaaaattgttctcaaaagaatggctcttcttcccaaagagtccatggtgtacatggcgaaaaaagtgaatatgaagttcgttgaggcaatcaaaattggaggcagtagagggttttttatattaaatttggaaaatattattgccgcatagtacataaaagcattaaagccagtgatttgctggaaaaacattaacatgcaacctactattaacgctcttattgtgcgtggctccattctgtgtcttttctttttgttagatgccagggcaccgtttggagctgggcctcgcaacgccgatagatatgctgatgaggaggacattgtgttgctagttctttctgtgttcgaggaaagtcttttaatgttaggtgggctaagagttcctgaggttgaactatccatgtatcgaataaccgattgggactgtactagtaaaggttcacttgcatcttcgtatagtcgtaacttatcgagttcaattatcagctgcttaattttactattcacatgatatgtagatgcagtaggatatagcattcttagagaatccctggtatatagaatgtctcccttggaaatggaccatcgtggcgattcagggataaaatccagtattgaaaggaacagaatagctggaatagcagaaagtgcgaacaaatatctccatgaattatcaatctctttcataagggacgcaatcacataggaaaccaattgacctccagtgatggcaataatgttcaatgtcaacataaaacccctgattctggaaggtgaaatttcactcagaaatagagggacgcactgggcagacactccaacagcgatcccaaccagcaatctcccacaaatcaaaaacgtcaatgttcttgctatagccattccaattgcagctaggataaaaattgaacagcagattgcgagagtaattcttcttccatacctatctgctaaaggaaatgccagaatagagccaaaaaatgatccgacgcttgtactggaagttatcagctccttctgaacatccgttaaaactaccaaagatagatcttcgggctttaaagaaagcagaacacctgatataacaccagtatcatagccgaataaaagcccaccaatggtagcaccaacgaagattaacgacgttttgaacgttaaagcatatgggagttgctcgatgtcattggcagtattggatgttacctgggagataatggaatacagatcagaataaacgtcttcactttcatctgtagacatacctctatcaagttttgactttcctgtcgcttgcctgtacgcttttgttttctactgagaaaagatactttttgaccatggactataagtgcacgctacagttgcacatataaggttgtatatagttcaagaagttcctttcgtatggaaattttgttatgtataccttccagttgctatggtagtctacctgactaaattatcaatccgaccgatgttcggatgttgcgataatattggtaccggaaaaaaaaaaggagagggctttgtagtgtcgatgtttaacaacctgttttaaggaataaagtaaagtgaggctcacctggtcatttaacaccaagaatcaaggagccaataagtgcacatgagttttaaagggtttaccaaggctgttagtagggctcctcagtccttccgtcaaaagttcaagatgggtgagcagacagaggatcctgtttacgaggatgcagaacgtcgttttcaagaattggagcaggagacaaaaaaattaagtgaggaatcgaagagatactcgactgcggtgaatggaatgctgacacaccaaattggatttgccaaatccatggaggaaattttcaaacctatcagtggtaaaatgagtgaccctaacgctaccataccagaggacaacccacaaggtattgaagcaagtgaacagtatagggcaattgtcgcagaattacaggaaacattgaaaccggatctggctttggtggaagaaaaaattgttacgccatgccaggaactgttgaagattattacttatattcgtaaaatggccaccaagagaaatcacaaaaaattagatttagatagacatctaaacacttataacaagcatgaaaagaagaaggaaccaaccgccaaagacgaagaaagattgtataaagcacaagctcaagtggaagtggctcaacaagaatatgattactataacgacttgctaaagactcaattaccaatactgttcagtttggaagctgaatttgtgaaaccattatttgtctcattttatttcatgcaattgaacattttttacactttgtataatagacttcaagacatgaagattccatattttgatttgaacagtgacattgtagagtcgtacattgccaagaaaggcaatgtggaagaacaaacggacgccttgactattacacactttaaactcggttactctaaggcaaaattggagatgaccagaaggaagtatggtgtagcaaccgccgaaggctcacccgtcagtggcgcatcaagcggtgtcggatatggtgctgggtatgatccagcaactgccacttctccaacccctacaggatacggttatggtgccgcagcaccaagttacgccgctcaacctgctgcccagtatggtactgctgccgccgttggtactgctgctgctgttggtactgctgctggtgctgctgctggcgctgttccgggtacttatccacagtatgctgctgcgcaatctccaccgctcactgggctaggcttccaacaatcaccacagcagcaacagggaccaccaccggcctactctaatcctctaacatcacctgttgcgggcacaccagccgcggccgtagcggcagctcctggcgttgaaactgttaccgcattgtatgactaccaagctcaagctgctggtgatttgtctttccctgccggcgcagttatagaaattgtccagcgtactccggacgtgaacgaatggtggacaggaagatacaatggccagcaaggtgtgtttcctgggaactacgtgcaactcaacaagaactagaggaggcccctgcatccctctgtattcattaccttctattgtgagatgttaccattacctttttcttttattgtaatgtttcttaatttaaatactatatagggtaattcatccttccaccaacaaagtatcgtttgagtctatctattacgggcatgcggcgagcatattaccctactgacaatatcccaaaagggaaggagcgcgttcccaatagggctgccaccttcccaatatggtacaaagcctaccatatggggaaatcagttttctcgctcacctcgcctagtcttcctaaaacgacgttcctcagtctcctttctcttttataaaacaccatctctgtcttgtcgatgacacagcccagttgggaaaccggtgctgacaaacaggaaaaaagcaagactagtggcctggcgcggaagaaactgagctacattgcacaacatcttcaagcagggtgtacgcattcattactttaatactaaatttagaagaaatcatcctttttactcgcgaaactgttaggcttgatcggacgatctcagaagaggaaaaacaaattgataaagtcttcgttaggtttcctagaatagcaggcccgttacaaaaaatttttttacccattccactggttttattcactagtgacttgaaaactccacatatttttgatctcttaagctttcacgcatcacaaagttatcagaacaaattttctccagaaagttatattgcagtgttcaaaaagccgttctcatttcacagcaatttttttctaaagtagaggggcagagaaattagccttcacaagtttgctttcgagcttccaatttgattcctgctttggtcttactttcatcctctcaataccactaagataaactaaaaatatctttataatgccaaataatactcttaaacaaggctccaaaattgaaaatgtttctccctctaaaggtcatgtcccaagtttttggaagcagttcataaacaaccctaagagtatgtcatccgaaaatattacagtccctagatcaccaacttctctttcaaggaatgctcaaccaactactttaaaacggcctccattatcttcaagaccatattcatataataccccaaccaaagataggaaatccttttccaaatccgcgaaacagaacaataacaataacaacgctaattccggaacatcgcctcacgcagagttcaaaaattacagagatatgtttttatctaatagaaatggtttcacaggtagggttttcggtgttactttagcagaatcgttgagcgtcgccagtgcagaggtcattgttcaaagtgagttggtgagttttggtcggatacccatcgtggtagccaagtgcggcgcatacttaaaagcaaatggattggagacctcgggtatatttcgtatagcgggcaatggtaaaagagtaaaagcccttcaatacatattctcgtcgccacctgattatggtaccaaattcaacgattgggaaacatatacagtgcacgatgttgcatcgctcctgaggagataccttaataatttggccgaaccactaatacctttatccctatatgaacaattcagaaacccgctacgatctagaccaagaatcctaaggcatatgttgacccacgaagtttctcatccgaatgcgaataaaacaaataatgtaacagtaaaatcaagtagacagaactataatgatgatggtgctaatgatggtgacatcgaaaaggaggacgctaaagatgatgaagaaaaaagacgaagaaaaatacgtcataagagaaggctgacccgcgatataagggcagctatcaaggaatatgaagagctctttgttaccttatcaaatgacacgaaacagctaactatatacctactcgatttactgagtctttttgcaaggcaatcacagtttaacctaatgtctggtagaaacttggcggccatcttccaaccttcaatattatcgcatcctcaacatgatatggaccccaaagaatacgagttatcccgactagtagtggaatttttgattgaatactcgtacaagctattaccccatcttttgaagttggctaaaagggaacaacaggaacggttgtcaaccgaaaataagaaaaataatggagataaacagaaaactgatcctatagaaataccaaagatcacctcatcggattcgccaccaatagtttcttccaataaaaacccaccggcgattgacaataacaataaactagaccatacgacgttatcgccaatatctacttcgataccggagaactcatcagacctacagacttcaaaaatgttaaagcctccgaagcaaagaagaccacactcaaaatcgtttggttctactccggttcctccggatgttattgctagtaataaaagaagaacgagtttattcccgtggttacataaaccgggaattttgagtgacacaggagacaatggcgacttaactgctactgaagctgaaggtgatgattatgaagaagaaaatgttgatccatacggtcagtctccatctagcgtacactcaggttctttgcccaaacagcattatctgccaattcctcgaatgaacagatcgttgagtggaaacagtaccaattcgtcctttaacactagacctatttcaatgatcctgaccagtggtaatgataattccgctgatcaattagaattactaagtaacactcatagcaataatgagcgcagtaatgctttaccattaaccgaagatgatggggatgaaagaaattcaagatcacgcaagagggaatcatggtttcaaagactaacaagccgttcaggctctgctaacagggcttgataacaccatttttctttccttttaatttcctcatttttttttttttcgttatttcccttaaaaacctgttggcggttttctttctttttctttgccttctgtataaataacaaataaacatcattcccctttcaagatttataaccataaagggaacatatataacataaatcatgaagaggacaaattacggacaattattctgtagcgatgctaatcagtataaaataaaagaataaaaattcttaagttgttaatatgccagagaaatgttacagcttgtaactcttcaataatgaatttctatgttatatgactggctgtttcatataagctataacagggatcatgatcattaagcattttctctgcaacatttatgtcgtacactgcgaaccacgattaaataaatatatagataccttttcttatttattagtctaattcaacaatatcagaattagtcggttcattaactaactttgtccttttgttactgggcgcctcagaaatctcagtatcaactggcctcttctttgaaccattgatcggttcagcatcgatggtgatctcaccttcatcgtcgtctaatatcacgataccatctttcccatgactgttcgtagttgcgactacatctgcacccttttcatttttttcttcttcttcattttttgaaggactattgttggcctttattaatgggacttcaacgtccggtaagctgcaagtattacatgggagttcatcatcaacatcaagaaataattctatggctttgcggatcattgtatcaccttcttcgtcggagaataatattatagaaccatttccaagattaatctccgataaagtacgatcgttcaaatcctcgaaatcgtaatcaaatagtaacctttgattacttgcgtccaggagcgaaatatcctgtggatatgagtacttctcgcgtattaaaactacaaaatcacttagtttcattttgttcaaacaatcgctggataacttaataacacctctacaaactttagagcaaactgggcaatttttatttggaggggctagtttcggatttgataaataacgattttgggatagattgcttgcctttgctgtgaaagccatattcaaatcagtatacttagtagttggggcatatttcaaaagatttaaaacgcgcagtgaaatcaatgacgatgcaccggcaacgatagcattcgttgttgcaatagccgggataatgttaccagcaatttgcttgatgtcaaatacggacttcattggaatattgaatatgtgtgaccttatgttcgcagcagttgcgacgaattccaaagtatcagcatcatctttatcaaattcaatatgattttgctctttgggatagcgatccattaatttttgtgtaatattaatgaaattactaatttgctcctgtattgtgccaacagaattagaggcagactgagctgttttagtaggagtatttatttgagagtctgataatggtactggctttgttctcgttttccataaattttcaatggctagcagtttatttatatcctgaatgaataatttattaagaatctctggaatacgggatgcatctcttgatatgataattttttgcaattcatacaattcattagtttcttgtttaatgcgcttaatttcttcagcatcatctgtaccccaatcctggttgttatcatcttcatttccagaggtctctgacgcaaatagctggttaaatagaaagtttttcgcccaaacaatgcaatgaattggctgagaaggagtggacctgatagtacacacaggaaaagtctttggtgtttccttctttgtacattcaaaacactcagttttcccggggataataggctgcatgtatccatcaaatccagctgttccagattctattaagggcagtgatagaaactgtgatattttattgacataccgtcttgcggccaagttatcaagagcattgaagataatgtcaaattgctcaaaccaatgcagtgggaaggtagaaatgtccataacatttccttggtaaggcactaacttagagttattgaaatgctgtactgcttttacggctgtggtagacttcggttgtttaatatctttttgtctaaaaagaaattgcctgtttaagttcgaaaggtcaatggtgtccaaatcgacaatatgtatttcaccaaattccatcaagattatatcctttaacaattcagaccctatgcccccagcaccgaccagaagacatcttgaggaccgtaatttcttgtaactatcttcaccgatgattgttaccaaacttgtttcccttggcattttcttttcttgtttggcgtagcgctcctgatcttgtgtgtctgttgaagtacgcaattagtggattgctcatccaaatatcttgatttagcgtaaacatacttcgcctttgaaaaactttaacttgaaaatagagtataaaaaaaaattgcacaaaaaatgcggaagccgggaatcgaacccgggccccatgcttgggaagcatgaattctaaccactgaaccactttcgctaagaagatctagcttacataggttttgtggtaatataaattcttgagaccgtaaccgcgcaaagaaatacctaaaatagtaattgctaactacatctaaaaacagactgaagctcactagatatgagacttttctcacatcttcaaaataaagaaaacaatagcaggcgaaatttttttgaacctggttatacagtgcatgctccaaaatgtcgtctttaaacactactttttattctaaataattacttgaaggggggaaagaaaaagctcaaaaactactcttttaagactttattaccgtccttatgatatatcattaaataggctgtgaacccttcaccattcggatcgcaattgccgttagagtcgacctcacactcaccgtatttgaacgtcatgtaatttctaaatccaaaatattcgtacacagatttagcatgctcggcaatagcttcaaggacaatggcgcaattttcttcgtctgctctccttttgtactcttcaaaaatagtccttacagaacctctgattcctttctcatttaagttcttaccaatacagaaaagatagtagtaattgatgccatttggaatgacttgctttacgcgagcatttaaatcgtcaataaagtccttgttgaactttgcatcattactccttgccttcggaacgtgaggtggaagactccacactgcaacagcatcgaaagtattaacttcggagatctcaccataaggtgaatccaggaatggcgatatgatatcggtggttattgtccttgtaggcaccttctcagctagaggaatatttaagattttcttgcagataaaatgaaacgctggcgagttactaaaagcaatagacaaagtctctgctgctcttctggcatccgtagtcttgttcagggtacagaccatatggcccttagcatcgttgttttctaatggagttggcagtttgttctcgaaggacatgatgttcggttacatgtcttagaattattttctcgagattagtgagtgacttggcataatatcaggtacaataactgttatatatacgccggcggcatttcatttttttcacttatctcagcccctgggactctgatgccgttcacaccaacgtctgctgtgatttggagtgaaatatctggatactaatagaaatattacgataaaaaagagttatctacagtttgctgcattatttttgcgttatcggtcaatcaactttaagagatcaccgtacatttccggcagcattagcgggcgtctcttagtttctttgcaatacagtaggaactccaattttttgttcgtctcctcgctacattcagattcaactgcaatctcgaaaacaagttttttatgccgccaaaataggtatacattgcgttcaatgcattctcattcatctctatcgcaagaacgtcttgttcaaagctgccctttcttgaggcttcaagcgcagcgcacagaaaagaagaaaatccgaaccatgtaatatagatcggcggaaacgaaaagtaaaaagtaaggttgaagacactctgaacccggggaagagtgcatacaaggtaccgtgccaaaattcaagagattagggcaggaatgatggacaagcataagtatcgtgtggagattcaacagatgatgtttgtctctggtgaaattaacgacccacccgtagaaaccacatcactgatagaagatatagtgaggggtcaagtgatagaaattcttttacagtcaaacaaaacggcgcatcttaggggaagtaggagcattctccctgaagacgtcattttcttgatcagacacgacaaggccaaagtcaatcgtttgagaacatatctgtcatggaaggatttgcgtaaaaacgccaaggaccaagatgctagtgccggtgtagcgagtggcactggaaatcctggggcaggtggtgaagatgatttgaaaaaagcaggtggtggcgagaaagacgaaaaagatggtggaaacatgatgaaggtcaagaaatcccaaattaagctgccatgggaattgcagtttatgttcaatgaacatcctttagaaaataatgacgacaatgatgatatggatgaggatgaacgagaagctaatatagtcactttgaaaaggctgaaaatggctgacgatagaacacgaaacatgactaaagaggagtacgtgcattggtccgattgtcgacaggcaagttttacatttaggaagaataaaaggttcaaggactggtctggaatttcgcaattaactgaggggaaaccccatgatgatgtgattgatatactggggtttctaacttttgagattgtctgttctttgacggaaacagctctgaaaatcaaacaaagagaacaggtattacagactcaaaaggacaaatcccagcaatctagccaagataatactaactttgaatttgcatcatccacattacatagaaagaaaagattatttgatggacctgaaaatgttataaacccgctcaaaccaaggcatatagaggaagcctggagagtactacaaacaattgacatgaggcatagggctttgaccaactttaaaggtggtagactcagttctaaaccaattatcatgtaaatttttgtataatttcatcatggaggtgcatgggtttccttctggtatgataaatgtgagccaaatgaattgaaaaatacaaataaagattatgtacgtagatacgcgttataaagaggactatctgatcattggggtctttttcgttgtgaaattgtaacgggtgaactcagtgattaaaaaattgcgtgatgttgagatactatggggcgacaagaaacttacccttagtattcagcattaacaaattaatgttgagggcgtcatctttcaccaggccatttcattatagttcatattctctacagaacggtgatactcctgataaaggcagcactaataaaaatgaaatacggacacctaataacgctgtttggaaagaaaatatagaacttcaatggcagcacttgaaaaagaaattaaatgaattgtattctaggtttaacttccaccgagatcaattatcctttcaagttaacaaggccaaaaaatcaattcaagaggcaaacaggaagttgtctgagcaagagaatgaaatcaacgattcccgtttaaactataataaagatgaattgaccagtgcgaaaattgaaggattgccctccgaaagggaacaacatagaaaaaaatggtctagaaagttagagttttattttgactcattacaggagacgttatttactgccacacgtgctttaaatgatgtgaccggttattctggaattcaaaagctcaaatctagcatcagtctaatggaaaaaaaattagaagctacaaagaaagaacacaaactgtttaaggcacagtacgctaacgccattgatgaacgtgctcaatcccaaagagaagttaacgaattattgcaaaggcaaagcgcgtggtcttcgagcgatttagagagatttacgcagctatacaaaaatgacgccttgaatgctagacaggagcaagaactaaaaaacaaggttaaagaaattgaaagcaaagaagaacaactaaatgacgacttgtatagagcaattttgaccaggtaccatgaggaacaaatatggtcagacaaaatccgaagaacatccacctggggtacattcatcttaatgggtatgaatatattcttgtttattgtcctacaattactattagaaccttggaaacggaaaaggttagtaggatcgtttgaagacaaagtcaaaagcgctctcaacgaatatgccaaggagcagaatatgaagatggataaattgttacctggaaaatcatcggaagtaacagaccaaggcaacacagaaaactcgatcgttgaagagcacatagaacagagaggtgaatgtaaaattaatacggcggaaatcgacaggcctgaagttgcaacggctgagaccactacaacagaaatgaaatccttcagagatatttgggaacgaataaaggcactttttgtcacactaaaaagcatacaatataggaaacttgacgctcccctagtctttgacaccttagagttctacttatactcaatttctttagtgagtatgacaatcttggtatccgggctgatatgacatgatatactgcgcaagaatatcgttaaaaaaacacgcatgcatttttttcatcctttatccttgtacataataaaatcataaatacacagtaaatagcacgttttggtttcaatatccttaaccttacctagctaatgtttagctggtgtaatccattataatcaaaatttctctaatgtttggctcttcgtagcgcgcgatgtgccctttcatatttttcctgaaagtaaggtggcaaaatagtaaatctgcagtaattgggtatagccatgaatataggaagtaatagggctcagattctcagtgtgtggacaaaccaattctgcctatttcctttcactcataagttatacaagaggcaatcggataaaattcaagtatttataaagtaaaaaccacaacaagaatggaggaactaggtattgtgacacctgtcgaaaaggcagtcgaagaaaaaccagccgtcaaatcatacgcatcattgttggctcaactcaatggtacagtcaacaataacagtgccctgtctaatgtgaattctgatatatatttcaaattgaagaaattagaaaaagagtatgaactgctgactttgcaagaagactatattaaggacgaacaacgccatttgaaacgtgaattgaagagagctcaagaagaagtaaagagaatccagtcggttccattagttatcgggcaattcttagaacctattgatcagaacacaggtattgtttctagtaccacaggtatgagttatgtcgttagaatattatcaaccctagaccgtgaactattaaagccatctatgtctgtagctttacatcgtcattcaaatgctttagttgacatcctaccacctgattccgactctagcatatccgtaatgggcgaaaacgaaaaacctgacgtcacttatgcagatgttggtgggttagatatgcaaaagcaagaaatcagggaagccgtagagctgccattagttcaggctgatctatacgagcaaatcggtattgaccctcctaggggtgttctattatatggtccaccaggtaccggtaagacgatgcttgttaaagccgtcgccaatagtacaaaagctgcattcataagagttaatggctccgaatttgttcacaaatatcttggtgaaggtccaagaatggttcgtgacgtctttagactcgccagggaaaatgctccatccattatattcatagatgaggtagattccattgccacaaagcgttttgatgctcaaacgggttccgatcgtgaagtacagcgtatcctgattgagttgttgacacaaatggatggtttcgatcaatccaccaacgttaaagtcatcatggctacaaacagggcagacacattggacccagctttgctgagaccaggcagattagatagaaagattgagtttccctcacttcgtgataggcgtgaacgtcgtttgattttcggtaccattgccagtaagatgtcccttgccccagaagcggacttagactcgcttattattcgtaacgactctctatcaggtgctgttattgcagcgatcatgcaggaagctggtttaagagcagtgaggaaaaacagatatgtcatcttacaaagcgatctggaagaagcttacgccactcaagtcaagacagataataccgtcgataaattcgacttctacaaatgattaccatatatgcttcaacgtaggtctacataaagtattacgtacatttctatctagacaacactaaatgaaataaatacagacgccacttttttatcacgtttcttagcgttattccgcgcgcaaccggacgtcgctagccaagtttttcacttttttttttctgtgatatttttttttccaaatgagatggtaagatgagtacctatcaacaagtatctcaatcaataaagtacaaccaaaatatcaagtacgcagtctctgcttcatcccagtgtagatttgctattcgatttgtgtcataaacatttaacattgcgcccgtctacaacaaaggagataaatcaaaaaaggaaatggtacaagaacaggcaattttgagctgcattgagcagactatggttgctgatgcaaaaattatcaaagaggcagaacagcagttatttgagttccagaagcaacctgggtttacttcttttctgcttaatatagtgtctgatgataattttgcgctaaatgttcgtctttcttctgctatttatttgaagaataagattcacagatcatgggatactaagagagaagatggtataaaagctgacgaaaagctttcgatcaaggaaaggttaatcgagactttagttaaaaactgtgaaaataaccacattaggcctatcctgactgaaaccataaatgggatacttgttggtcaggaagattgggatttagcacctattatcaagaatttattatcgagcggtgacgcatcgtacatttatcccgggttactactactgttccaactttgtaaagctcataggtgggacatggttgggtcgagagattatattgattctgttatcgaagaacttttccctattgtggaagggatagcttctaatatcggtagtcaaacggattacagatctaatgaaatattgtacctcattttgaagtcattcaagtatgcatgtttgaacaacttgcctcaatacttcagccaacctgaaagaattatgtcatgggtgcaactacatttgtatttatgttccaaaccattaccagtcgaagtaatggaactggatcccgcagataggtccctagacaaaagggttaaagtgaacaaatgggggttcggtaacttaaacagattcctgcaaagatacaacaaaattacaaaggccatcaccaaggaatttatcgactatatcttcaatactattgttcctataattcttcgagaattttttaaggatattgaagcttggggtaataattcactatggttatccgattcctctttgtatttcttaatttcattcctagagaaatgtgttacaatagatcaactttatcctttaattgagccacatttacaaattatttttgagaacgtcatcttcccatgtttgtgtgctaatgaacaatccatcgaattattagaagatgaccaagaggaatataccaggcgttattttgacattaacagagaaggctctacgccagatgctgcttcagcagatttcatattcttgattgggtccaaacgtcctgagaaactgaacaatattttaccgttcattaatgatatttttactagattcgatgccaattccagtgatattaacatggcatttaaagaagagggtgctttgagaacattgtctaacttgttttcgtttatagatgagccatccgttctggagaatatttttggacacttcatcgtgccattgttatcgcaggataagtacatgtttttggttgcaagaagtttggaaacgatagcgctgtattcggaagaatttaaagatatgaacatattgtcacaattatttgagttaacatataccaacttcttaaacagtaacgttttaccagtccaaattgaggccgcagatgccattaaatgtttaattgtatccaatcctcaaatccacccagcggtctctgctcatgttccaggtatgatggaaaagctattgaaattgtctaaaatctttgaaatcgatatcttatctgaagtcatggaagcattggtggagagattttcagatgaactatccccatttgctaaagatttagcttcaaacctagtcgaacaatttttacgtattgctcaagcattggtagaaaatccatcggaaacctacagcgcaagtgaccaagagcaggaaatccaggccagtggattgttacaaacaatgactactatggtcatgtcaatgaataaagttccattaatcgagtccttagctcccgtggtcaagtttgttgtacttcatgcacaaatttcttttattacggaagctgtcgacttactggatgctttaactatttcttcgcatctgctttataaccaaattgcaccaccaatatgggagttgttacatgatatattggattctttccaaacttatgccatggactattttgaggcctacagtattttttttgaaaccatcgtgatgaccggcttcccacaagatcaaacttatgttcaacctctgctagaaattctctctgctaaactggaaagtgaagttgactacgacatcgagcatgttatgcaaattctaatgtacttcgcactgtccatgagagacattccattattcagcaaagccatcaaagtatccactaatgatgagctaggattggactctaaatgcatcgttaaactgggactggccaatttgtttgctaaaccaatcgaaactttacaaataatggaaaatgaaggttttactataaatttctttaccaattggtttaatgaaaagttctacagtgtcttcgccatcaaattacaagtcctggtcattttaacccttttgaagatgcctgaagttcctaatagtgtcagcccactactaaataacctgaccaataaactggtggaattgacattatcattgccaaaggcaattagaaaccgtgatgctgttaccgagggcaaatccttagaaggagacctgaccccagaagaagaagaagaatactttatcgaatgtgatgatgatatgaaggagacagtgttagaccaaattaatgttttccaggaagtacatacctttttcaagaatttgcaaaacgaagatgccggtaagtacgaaaaaatcataaattatctggatgaatctaagagagattccttgcaggtaattctggaatttgtttctcaacactgaggagaacacaaaaaaaatagtggaatgtgatagtttgaaataaggatattagtttatactctaatatacaaatataaaagttgtttctttttcgttcttttttttttttggacttgtcttcgtttttattacatacatgcatgcgcttaacatattcccatgtggtttattttcgtatatagcattactttgtttagaagcttctattcaagaagaatcctccgacttaaccggatcagatacactattgtggtgtaatctggaccttgactgtctaaacaactcctcttgttgtcgtagcagctcttcttccgagagacctgacttcttgaacttggaatccctagtttctttcaccttctgggaacccttaaaattcaataatatttcctctaagaatggtataaactcattatactccaactcttctagcgctttgatcacgtgctcgggcgctatggttttcttagcctcgttgtccgccatttcggaagccatcgaggacaggatcattatgaattctatgccggagttgatgatgatttctcttgcatccttggtaaacatcaaatcctggtccagtatttcagatatcatcttttgtacggtcgctaagatcattcagtgttttctctaagttagtataaccgctcagtacccgcatcaaagcttgagttttgcaacaacaatataactaacatacccttgggaagcgacacattatcggagtctccagccatcaattaattaataggtacaactgtattagtaaatatcgttatgatttcttgcccaccttatactggtaactctgcacgatagaaatcgacaaggcgagcagagggcgaaaagcgcgaccaaaaaccgcttccatttatataggagggagagtgcagcgggctgggcgttttaaagtggtgcaagagttaattgcacatactggaatacgccaaagataagagcccgagctgattaaaccagatcgtaatttttgcggcgactattcgcatgaacaggctatgctgcatagtggtggcatttctttacaatagttttggttgaacgtgttgtacagttccccttattctttgattgtcatttaacacggggatgagcttcttgacaaaaaaattttatccaattttttttcatttctttttctaatctttcgcagctgaagcgatgaggtgaaaaaattaacaagtattggataggatatatgtatgtaaagatagatgcagagcatatatagtttaaacttggcttagcaagagggtaaaagacacatttgccttataattgttcattaccgatggattctcctgttctacagtccgcttatgacccatcaggtcagtatttgtgttatgtcactgtagctttggacaagcaacgcgttggtgtacagcccactcaaagggccacttcctccggagttgatacagtgtggaatgagaattttctgtatttagaggactcgaaattgaaggtgacgtgcttaaaatgggtaaacctggcttcttccgacacagtggctattatattgggtatgaataacggtgaaatttggctatattccgtattggccaacgaagtcacctataaattcactacggggaattcttacgaaatcaaagacatagacttgatgggtaatcaactgtggtgtatcgactccagcgacgcattctatcagttcgatctgttacaattcaaactgttacaacattttagaataaacaactgcgttcaattgaataaactaaccattgttccagcaggcgattctgttgcacaacttttggttgcatcccattccatttctttaatagacatcgaagagaaaaaagtcgtaatgacatttcccggtcatgtatctccagtgtccacattgcaagttataactaatgaatttttcatatcaggcgcagagggtgatagattcttgaacgtatatgatattcattccggtatgaccaaatgcgtccttgtggctgaatcagatatcaaggagttatctcattcaggccaagccgattctatcgcagtcactaccgaggatggtagcttggaaatttttgttgatccattggtatcgagttcaacaaagaaaagaggcaacaagtccaaaaaatccagcaaaaagattcaaatcgtcagtaaagacggcaggaaagttccaatttataacgcatttattaataaagaccttttgaacgtatcgtggttacaaaatgctactatgccttacttcaagaacttgcagtggagagaaatccctaatgaatataccgtcgaaatttccctaaattggaataataaaaataagtccgccgatcgcgatctacacggtaaagatcttgcctcagccaccaactacgtggaaggtaatgcaagagtcacctctggagataacttcaagcatgttgatgacgctataaagagctgggaaagagaattgacttctttggaacaagaacaggccaagcccccacaggccaatgaactattaacagaaacatttggtgataagctagaatcaagcaccgtcgcaaggattagtgggaaaaaaacaaatttaaaaggttccaatctcaagactgctacgacaaccgggacggtaacagtaattctgtcgcaagcactacaatcaaatgatcattcactgttggaaacagtgctcaataatcgtgacgagagggtcattagggatactatcttccgtctgaaaccagcactggctgtcattctcttagaaaggttggcagagaggattgcaagacaaacccaccgtcaaggcccattgaatgtttgggtaaaatggtgtttaatcatacacggtggctatttggtttctattccaaatttgatgtctactctatcgtcgttacattccaccttgaaaaggcgttccgacttattaccaaggctactagcactggatgcaaggttagactgtactataaataaattcaaaactttgaactatgaagcaggcgacatccactcatccgaaccagttgtcgaagaggacgaagacgacgttgaatataacgaagaactcgatgatgccggccttatagaggacggtgaagaatcttatggcagtgaagaagaagaagaaggtgatagtgacaacgaagaggaacagaagcatacctcatctaagcaagatggccgtttagaaacggagcagagcgacggcgaggaggaagccggatatagtgacgttgagatggaatagaggatatcatgcataaaatgctttcacgcatcagaatacaaaaataatctctaggcacataaatacttatatagagttcaccacataatgtaagaaaagaaaaaagaaaaaaaaagatcacgaaagtatcccacgcgaagaagatctgtcaaaagacccccacaatcgtttatcctttttgaactgcatctggcatcgttaacagtaaggccatctggaacatcaagcaagcactccacttttacgtcacaaccatagttggttaactaagaaaagacagtacatatttcccttccgagtcacttattttttttttcttctgaaaaaattaattagattaatttcaattaatatcatttccgcttatctgacttctttcattttttttctctatatttcgcgtttactaggaaagaaaaggaaaaaaaatttttccccctccatctgtcccaaatcgggtagcgatgagctgctatagaattttctatttaaacatgtttgataagcccaatttccgttagattttgttcccccttcgcagtttggtttgccgtaacttttttattttagtctccatctagctggagtaatacgatgtagtgccttgtaatctttcttatttttatattaccgttcgtgttcattatatccattacgttcccataatgtcggcaaacgataagcaatacatctcgtacaacaacgtacatcaactatgtcaagtatccgctgagagaattaagaatttcaagccggacttaatcattgccattggtggtggtggtttcattcctgctaggatcctacgtacgttcctaaaggagcccggcgtgccaaccatcagaatttttgctattattttgtctttgtacgaagatttgaacagtgtaggctcagaagttgaggaagttggtgttaaggttagcagaacacaatggattgattacgagcaatgtaaattagatctagtcggcaagaacgttcttatcgttgacgaagtcgatgacacccgtaccacacttcattacgctttgagtgaattggaaaaggatgcagctgaacaggcaaaggctaaaggtatcgatactgaaaagtctccagagatgaaaacaaacttcgggatttttgttctacacgataagcaaaaaccaaagaaagcagatttgcctgccgaaatgttgaatgacaagaaccgttattttgcagctaaaactgttccagacaagtggtatgcatatccatgggaatctactgacattgttttccatactagaatggctattgaacagggcaatgacatctttattcctgagcaggaacacaagcaatgatagacatatcatatccttcagtaacttgaatcatacagcagaatttgtacaatagacaacgcatataactgcgaccatatgtatacgtataactaattattatctcaaagtttattcccttagcctcaccggtaacctgtgaggcgcgattacgttttccctctgttcaccaccacgtaacgcgatatttgacacatacgtgacaactacttttgatggaatctgctgatttttttacctcacgaaacttattaaaacagataatttccctcatctgcaaggttggggaagggttggacagcaataaccagcgactgtttgaagaaaagatgactgttagtaaaatacccatatggctagattgtgatcctggtcatgatgatgccatagccattttattaggctgtttccatccagctttcaatcttctaggaatcagcacgtgttttggtaacgcaccgccagagaatactgactacaacgcccgttctcttttgactgcgatgggcaaagcacaagcgattccagtttataaaggcgcacagagaccttggaaaagggaacctcattatgctcctgacattcatggtatatcaggtttagacggcacttctttgctacctaagccaacatttgaggcaagaactgataaaacgtatattgaggccattgaagaggcgattctagctaacaatggagagatatcctttgtgtctactggtgcacttaccacattagcaacagtttttaggtgtaaaccatacctaaaaaaatctgtcaaatatattagcattatggggggtggactccatggtctaggaaactgtaacccaaatctttctgctgaattcaacgtttggattgatcctgacgcagcgaattacatattccgtgatcccgatgtaaaggacaaatgtatagtagttcctctaaatttaactcacaaggccatagctacttacaaggttaacgaaatgatatacaacgaaaagaataacagcaagttacgagaattgtttttggagctttttcaattttttgctcatacctacaaggatatgcaaggatttgaatcgggcccacctatacatgatccggtagctttgatgccgcttttggaattttatgggtgggatccatcgtctgcggttggatttcgctacaagagaatggacatatcctgcattgatgatgttttcaacgaaaactcagggaaaattatcattgaaaaagaatatccaaatgacagtgatgttggtacaataattggtctcgatttgaatatccagtacttttgggatcagatttttgaagcattaaatagagcagacaaaatgtcaacgattggataagaacttctataaaaggctttttttttttctactgacctttggtcaggttctgttcctttcattttcactggatacaaagaagtttcactaaaagttgtcgcgattgtatacatatatgcgtatatatacaattctacatgttttatatttattccattatattctcgttaaattttaactttaaattaagagggcaaagaggcccagcgggagttaatttttcttcccattcagggtcaagactccatcgaaactgtttcaacatttcagccaaagaaattctcatttctgttagggctagtttttcccctaggcatgctcttcggcctccatggaacccagtcacagcacatctgtttttcgccattctccagtttttccttatggtttcgatatctgaaccccatctttctggtttaaaatcatctgctgttgtgccccaagttttgggatcgtgtgaggttccaaagttgttgtacccgacatatacgcccttgggtataacaatttccgcccccaacttgcacgttttggtagtacatctattaataattgtgctcaaaggaggatacattcttactacttcgaagagaaaagcatttaataagggtaaatctgctaagccttttggatcagtgatgccgtttacttccttcctgagtttctcttgccattcatttgaatatttggctagaaggtagagtgaactattaaatagcaactgcgggttttcatggccagcgacaaggataatgacgatattatcggtcaactgtttgtagtcgattatttcgttattgtgagcacgaattagatcactggcagcaaaagtagtttgttcaaatttgtaattattgactaattcatcttgaactcttttaacgagaagttctctaaaactaacaacatccttgaaggctttttttcttgaaggaataggaagaacatcaaggaatggaaaagttaaaaagaatggatgaaatatttgctttttaatacgaatcaaatgctcgtggaaagcatttttttcatgtgttagagcaccaaaatcaaatccaagggcaacctgtgaaatgttatccaatgccattctctgggataaaggtcccatagggatcgaagtttgtccttctaggagtctgttttttatcaaagtgcataaaatttttgcatttttgaatataggtgcatcgtcaaaatgttggagcccgtttgtcacagcatttctgtagtttctccaaactgcaccatacgcgctaatgacattgtcccctgtgtaagcggcaagagcactgtatgggattttcttttgattaccgctcttcgcaaaagtatcttcatctttgaatatttgtgctagatactcagaacgagaaacgagaatattccaccgtgaaccaaagaaaaattttacagcaccgtatttttccattgattccctaatataaagatcgtatagctccgtttgatcaatgggaaatattactggtaaaaatactacataaaatgggatggtgggtatatttttgggaaagtttagaggtgggacaatgattgcaaaggcgacataggaaagagtaagaaataaaatcaaacacagaagctttaacaactccatttttaatgcttttttcgatttattctcttagtctgaatcaaataccattttgaaaaaacgaaaatatttcaagaaaattaatgtatttttttgcactacctaatatactattcgcatcaggatgaccagtcattcctcttgtggtccgtggcttgtaattttcgggaaagatagaaatcactgcattcatcgaaagaagtgaaaataaattgtatcggggaagtaatgaggggtggaatacgtaattgcttctcaatttgataatacaagttacagtctttttattgagagtccctggaaggaaaattattgatgtttacctttttttgcgacgcgcgtctggccataaataaaagggttctcttgccaagaaaaaataaaaaggcgccttaagggaccttctatgacaaatatggtgaggtatgcaacctcaatgaagagcaatgagaaaatttaaggggtaagtaagcatcggaatttgttgtttcctaacaatttgtctaatttactcaataatatcaggagaattgatcgaaaaaagcaaaccaggaacccctcacaaataagggaacataaagtaattgctcgtctttacatacatggcactcaatcccagacgtcgcgtgctaaaaatccttatattattggcccctcaggagtttatttgaattttgattgcattgctttcagtggacagtatatcataaaatttgcaagggcatagtgcctgccctacgatgttgtaaaacaatttctgaaaataggttcagaatcaaaaatgatgtataaatattgaaataaattttcacataaattgtgctcctccgcaaagtcttgactaaataaacaatttgttaatatcctaattcggtaaagctttgtcgagacattaacaaaaatgacatttactagcaacttgccctcaagctccgagcagtcaatatcaccacctgcctcttcattttcttcatcgactgatacgttgaaagatattgatattccccataatggggccgatttgtctacatatagtaaatttctggccctgtattgcagaagcgacaaatgtgacgatttttactctttagaggaaaaacagaattgtaaatttggagaccaatggctcgactttatcaacactattcacaatctggacttttctgaatccgaagtaagtggacgggtttctgaaagaattttgccagcttctttagcaaataaatttaccaataatttaggagtggcaataaagatttctgaatatacacgcgatgacgaacgccagattcgtgggtgtgttacaacagttgagaatgaaaattctttcaataactggttcgtatatcatattttagaccaatctcaattatctctaagtgaacatccaattgtaaccaaagaagttaagtatcacgaattatttgcagatttttttgagaaaaatttgaaaaacacaatagttaatgatcaatggaattttggtggccgtgattattttattgaacgttcaagatattttaccgatcgatatttgagaattgaatgcatcttgccagcgtttccatgtaagtcatctaatgagcaaaaagtgtacggttccgttcctgacaaaggcgaagaactcgctttgaaaagattaataaaagccacacaagaccttgtcaagatatatccaccgggtatgaaaatttggatagttagtgatggccatgttttctccgattgtattggggtcgatgatgacgtcgtgagtacttacacgaccaaattgcacgaactgtataaaagagtggctatacctggtgttgacgccattggcttttgtggattgaacgatttattttttagcggtgcagctagtaaagttttcgatccaaagtgggttagtgatgttgaagttgcacactacacaggaactcaaatctgtcctaagtccgatttgtcgagacagattttgatgaaaggctgtgatacagatgcaggtcgtttgagaaagcagattgcaatagaaggacatccaagattgcatctgtataggggcttttcacgttttatgatggaagatttatctctactggaacatttccaaagttattccagaaaaaaattcaagaaaatcatttcaatgatcgcttttaacatgattaagagaaatgacgcgtattcgaacttagtggaattgatattccctcatcatttgagaatttctattcatgcgcacactaacagcgggcccaaatttggtataaaagtaatctccaacgaacagtgttctattgttagttcgttagaagaccttgatgaacccaaatttgaagattttttacatattcccacaccttggcataattgtgtcgtgaaggttgaggatgaaaaggagaaatactttttgacaaaatcaaaagtagtcaaggaggctctcgaaaagggtatgtatgatggtgtatggaaagatactcgtttcgatattggagaaggaggacatttcgttatcaagaaaatctcttaataaagtaagagcgctacattggtctacctttttgttcttttacttaaacattagttagttcgttttctttttctcatttttttatgtttcccccccaaagttctgattttataatattttatttcacacaattccatttaacagagggggaatagattctttagcttagaaaattagtgatcaatatatatttgcctttcttttcatcttttcagtgatattaatggtttcgagacactgcaatggccctagttgtctaagaggatagatgttactgtcaaagatgatattttgaatttcaattgacgtaattaatgatactattaataatacagagcgtatatgaagtattgcaaataacatgcacagttcttttgggatgagaatgataatgaaaggcgaaggcgggcgttcagaaaagcgttgcggagtaacaagtgattaaatagcacccaaataatcttctttgatactaccgattgcgtgaatagaactcacttgactgatacaaccttcaattttaactctaattctactttttatggtgatgacatcctcggaactttggtatgatggtgggtttgaacccgcattaaaggttaaatcttgaggcatcagatgctttgtcacaaatactttcattggacctacttgcacttcgaacccgtgctgagaacatgaaacgactgtgccgtccactacttcccctttaaatggtttgaaaactacagctctatatttcacgttgaactcggcggacccatctgtgggcaatattctcccacgttgaatatctatattatcatagtctaggacacaaagaatatatccgaatttacccgtacacgaaccttcaacctcttccaatagttttgtctttagatattgcttcattcgaggaccgaaaaaggacggatgaagggtaatattaagcgaaaggtctttaataaaaaacattctcagaaattgagttatttatacagtggttgaaatgtgaatctattcttggactttcccactgtctaatcgcaaaggagaatggtgtaggaggagaaacggaaaaagaaaggctatgatattctgggagaagagataggtggacagacctgatcgacccaatgttagagaataaatcgacgaagtgagcttgtctacgttattggcattttcactgggatataggaataccgcatttattttccttgtatttttcaaaatagccgttgaaacccacagaagatcacttaatacgtaatcgcgttatacgaattttctcgatgaaaaagggaaaacgatggtattagaacttgaaatgtacatacatttcttgtggagaacgtaacgctactaacaaataatgtgctttgattagcaggctccaacagaaaaaaaaataaaataaaaataaaaagtacgcaacaccaacacagaatatgccacgattgacggttggaacgaagaatatgttgtatcctttgcaaaaaacacttgcagtaggaagttgcaagccagagcaggttccaataagatcactagcctcagtggtggagagttcctccaaaatactcgacaaaagcggcagcgatcgcgaagtagatataaacgtaagcgagaagatttataagtggacaaaggcgggcatagagcagggaaaggagcatttcaaagttggaggtaacaaagtctactttcccaaggccaggatcatcctcttgaggcccaacgcgaagcacacaccgtatcaagcaaaattcatcgtcccaaaatcgttcaacaaactggatctcagagactatctttatcatatctacggcttaagagcaatgaacattacgacgcagctgcttcatgggaagtttaaccgtatgaacctacagacgacgcggtttagagaaccgcagatcaagaaaatgactatcgagatggaagaacccttcatttggcccgaagaaccccgtccggacgaaaactccttctgggacagcaccacgcctgacaacatggaaaagtaccgtgaagaaagacttaactgcttgggctcagacgccaacaaacccggcacagcattcgacggagtcgtggggccttacgaacgggtggcccagccttttatacctcgcttcttaaaacgagagatagacaataagcgagagcgtcacgccgccgaactgcagcgcgcagataaactaattgccctgaacaggtacatagaagatctacattagaaggtttcccattccaccccttcgttaacccacacgcaaatacccagataagcatcttgcacccctcacacttgtatatacggagcaaactacataatctctaaacagaaaaaaaaaaaaagaaagaaaattaagaacattactttttccgagcaacaaacgcaaaaatatatgaagtggctgtagaacatgccttacggaagaaaagaatgatgatggcatccccttcccctgccctggaaggtggcctgtatttctgttctttttttatttttgttcgcgcaaagagcaagaacattggttgctttacttattattttcagggtcgcttccgcgggatgccatgcacggatgcctgcggagacagtggcgcggagccgtccgcatgctcgttccgcggagagtctcgagcgggtccgcgaggggcggatctgcaacgcacggtgccggggttaaggtatggcacgatggtaagacgatgagggaaaagaatactgctactgctgtgcgagactttggtagtagggatcggaaagggagcatgtacatctgaggaatatataagcaggagctctctacctggaccaaattgccttcttatgttgctgtaaagagatttgctagtcttgttgtagatacgtcatatgcagtattcaagtatactactgttaagaacatcacatcactaatactattagcgtataacagttactatacgaatatataaacacacacacacacaagcaaacacacttataattatcaaaaacctatgtcatcagatatcagagacgtagaggaacgaaattcgcggagctcgagctcaagctcgagctcgaactctgccgcccaatccattggacagcatccataccgcggtttcgacagcgaagccgcggaaagggtgcatgagttggctagaacactcacatcgcagagtttactatacactgctaactcaaacaatagctcttccagcaaccataatgcgcacaatgcggactcgagatccgtattttctacggacatggaaggtgtgaacccggtgttcactaacccggacaccccgggatacaatcccaaattggaccctaacagtgatcaattctccagtacggcgtgggtacagaacatggcaaatatttgtacttcggacccggatttctataaaccatactcactcggttgtgtatggaagaatctaagcgcctccggagactccgccgatgtgtcataccagtcaactttcgctaacatcgtaccaaagctgcttacgaaagggctcagattactgaagcccagtaaagaagaggacacttttcagatcctgaaacccatggatggttgtcttaatcccggtgaactgttggttgttcttgggagaccagggtcaggttgtactacgctgctaaaatccatatcttctaattcgcacgggttcaagatcgcaaaagactccattgtctcttacaacggtttgtcaagctcggatatcaggaaacattaccgtggtgaagtcgtttacaatgcggaatcagatattcatttaccgcatcttaccgtgtaccagacgcttttcaccgtggcaaggatgaaaacgccgcaaaatcgtatcaagggtgttgatagagaagcgtacgccaatcacgtgacagaagttgcaatggccacatatggtctttcgcatacaagggacaccaaggtcggaaacgatctagtcagaggtgtttctggtggtgaaagaaagcgtgtatccattgcggaagtcgcaatctgcggcgccagatttcaatgttgggataatgccaccagaggtttggactctgctactgctttagaattcatccgtgctttaaaaacccaggctgacattggaaagaccgcggctactgtggccatctatcaatgttctcaggatgcttatgatctttttgataaggtctgtgtcctggatgatggttaccagctttattttgggcccgctaaggatgcaaagaaatatttccaagacatgggctactattgtcctcccagacagaccactgcagattttttaacttcaattacaagtcctactgaaagaattattagcaaagaatttatcgaaaaaggtactagagtgcctcaaacgccaaaggatatggccgaatattggctacaatcagaaagctacaaaaatttaatcaaggatatagactctacattagagaaaaacacagatgaagcacgcaatattatcagggatgctcaccacgctaaacaggcaaaaagggcaccaccttcctctccatacgttgtcaactacggaatgcaagtcaaatacttgttgattagaaatttctggagaatgaagcaaagtgctagtgttactttgtggcaagtcatcggtaactctgtcatggctttcatcttgggttctatgttttataaagtgatgaagaaaaacgatacttccactttctatttccgtggtgctgcaatgttttttgctattttatttaatgcattttcgtgtcttttggaaatctttagtttgtatgaaacaagacctataactgaaaaacacagaacttattccttgtatcatccaagcgctgacgcatttgcgtctgttttgtcagaaatgccgccaaaattgatcactgctgtctgcttcaacatcatcttttatttcctagttgatttcaggagaaacggtggtgtctttttcttttattttttaattaatgtcattgccacattcactttatcccatttatttagatgcgtgggctccttgaccaaaacattacaggaggccatggtccccgcttcaatgttattattggcaatttctatgtatacagggtttgccatccctaaaacgaagattttaggttggtccatttggatttggtatatcaacccgctagcctacctgtttgaatctttaatgatcaatgaattccatgaccgtagattcccttgtgcccaatacatccctgctggccctgcttatcagaacatcacaggtactcaacgcgtctgttccgcagttggtgcttatccaggtaacgactatgtgttgggtgatgacttcttgaaggaaagttacgattatgagcacaaacataagtggcgtgggttcggtattggtatggcatatgttgttttctttttctttgtttatctaattctttgtgagtataatgaaggtgctaaacaaaagggtgaaatggttgtgttcctaagatctaagatcaagcaattgaaaaaggaaggtaaattacaagaaaagcataggcctggagatattgaaaataatgcaggcagttctccagattccgctacaacagaaaaaaaaatactagatgatagttctgagggatcggatagctcttcagataatgccggattaggactttccaaatctgaagcaattttccactggcgtgatttatgctatgatgttcctataaaaggaggtcaaagacgtatcttaaataacgtagatggttgggtaaaaccaggcactttgactgccttaatgggggcgtcaggtgcaggtaaaacaactttactggattgtttggctgaaagagtcaccatgggtgttattactggtaatatttttgtcgatggtcgtctccgtgacgaatcattccctagatctattggttattgtcaacaacaggatttacatttgaaaacggctacagtaagagaatctttgagattttcagcttatttacgtcagccttcgtcagtttctattgaagaaaaaaataggtacgtggaagaagttatcaaaattttggaaatgcaacaatattcagatgctgttgttggtgttgcaggtgaaggtctaaatgtcgaacaaagaaaaagacttactattggtgttgaactagcggcaaggcctaaacttttggtttttttggatgaaccaacttcaggcctggattcacaaactgcttgggacacttgccaacttatgaggaaactagctacccacggtcaagcaattttgtgtactatccatcaaccttctgctatattaatgcagcagtttgatagattattatttttacagaaagggggccaaactgtatatttcggcgatttaggtgaagggtgcaaaactatgatcgattattttgaaagtaaaggagctcacaaatgtccacctgatgcaaaccctgccgaatggatgttagaggttgtaggtgccgctcctggttctcacgctacgcaagattataatgaagtctggagaaactcagatgaatacaaagctgttcaggaagaattggattggatggaaaagaatttaccaggcaggtcaaaagaaccaactgcagaagaacataaaccttttgctgcatctttatactaccaatttaaaatggttaccattcgtttgttccaacaatactggagatcaccagattatttatggtcgaaatttattttgactattttcaaccaagtttttattgggttcacttttttcaaggctgacagaagtttacagggactacaaaaccaaatgttatcaatattcatgtatacggttattttcaatcctatactacaacagtatctaccatctttcgtgcagcaaagggatttgtatgaggcaagagaacgtccttcaagaacattttcgtggcttgcgtttttcctctctcaaatcattgttgaaatcccatggaatattttagcgggtacgattgcttattgtatttactattacgcggttggattttatgcgaacgcctcagctgctggtcaactccatgagagaggtgctttgttttggttattttctattgccttctacgtctacattggttcgatgggtttgttaatgatttctttcaatgaagttgctgaaacagcggcacatatgggaacgctattgttcacgatggcattatctttctgtggtgttatggctacccctaaggttatgccaagattttggatctttatgtatagagtgtcacccctaacttatatgatcgatgcattattagcccttggtgtggctaatgtggacgttaagtgttcaaattatgaaatggtaaaatttactccaccatctggaaccacctgcggtgactatatggcatcatatatcaagttggccggaacaggctacttgagtgacccgtctgcaacagatatatgtagtttctgtgcggtatccaccaccaatgcctttttggccactttcagttctcattattacagaagatggagaaattacggtatttttatctgctatattgcttttgattatatcgctgcaacattcttgtattggttatccagggtacccaagaagaacggtaagatttccgaaaaacccaagaagtgatgacgttattttccttttttttagttatattatctttttattatattctattctctctactggggagaaattacttaattttcatttatattaaaataatacctactgtttcatactttcactttaaccaccatttctttaagctaaagtttaggaacgctaaacatatcattgtttacttttcgaggaaacataactttcaacatcaggctcttttcgttttatattatctatattctatatagtagtttatagaaatgcatttaacactaaataacagacaagataacgttttcagagtcgaactggattattccatcttggttgtttgatttggagatgcaaacgctaaactcgtaccggcctttttcaattggaataatttctaagttaatttcagaaactttggttgtactgattggtttagttaacgaaccattatacaaaattcgtctgttcgatcttggtaatatttttgatgtcttgctgtcgaaaatcacgatgtccaaaaaatttacagtagaattttgttttcttctacatgtactagtcggctctgttattatcttcaagtttattatttcccctactttgacttttggctcatcaagcaatagctgcactccgtaaaataatctcccggggtatatcgtgtagaccatcttgtgatcaaacttttctatgaacttattgaaatccaccgaacctgttacagattggtctgtggttaatttccagttacatttaagctttgaaatgatatgttcgcgacaccaaaatttttgtctcatttctatagtctgttcttcgtttaaaccactttgaataaattgtcggcctggatagattcttggtataggtgtattctcaaaattatactttttgtaatcaatttttttaataggaacaataattctcgaggtatggcttgcctctacatgatactcattactagtgaaatcttcaaattgaacattcaattttattccgtcaatccaagaatttctgaagtctaataataacaatataaaatctctagagtggaggttagattctgcacgtattttgctcattacatactcaatccaatcaacattttcaacttgcgagctgaagagttcatttagcggtatgatgtccatacttggtacttcaattgttcttctcaatgttacttcatatggtattgataacttttttaaataaatgcaggattcatcagtagcgctcataccgtattcgatcaataagtcaaatccggtgaaattaaatggaacagcagtattatctaattccaaatcaaatgtgatggtttcatttggcttgattaccgttggtaatttaataatacgtacacaagacttagagagccaatctagctgtttttccatgatgtacaagtcatctggtggcatttttttccaataatcaggtttcaacatttgctcaatattattcattggtatgatcttaatatgatttattgcacagctcagtgatttatttctcaccgttatatgaaaatcagttttggtaccatccagcatcatccatgagtttcttgtcatcttggaagtactcaatagttctaattgtggttgttcaggcaggattttaatttttaattttccgtatatacatttactgtattctgcctcttcttcaacaggattcgatcttctagaatcgtttataatatcgaatttctgaagcggtagttttaggatagagatttttaggcatgaaatctcgtagatttttttgtatgttggctttttaataatcaaaggcaatgtgatggatcttattgactcggctttaacattatatggccctgaataacttacagcttttctatcaatctcacaaaattcagatatttcctcatctagttgaatatcattgatcgtaaaatcaaatttgaaaggattttgaaccctgcaggtgaattcagccttatcgccaactaaaaatactaaaataggaactttggtgctgttattagaaacaaaagaagttggttgaacccgtttgaaagggttgaaaacttcctgcggattaatatcctgtgtcttttgtctattttctaggctttcaaggctgctaacatctgactctaatgggatttcgtttgaagtggggtcactatccaatattctatttataacaacttccctcagaatgaagggatcccaataacttgtgatagactcgttggtaattgatggttgaatatattctttaaacaaggcatcttgttccgactgatttaacagatgcgtatatttcgtaattagtatcgagctaaatttagcgacatattcgaagtcattgatttttcttgaaactttaatgcatagttgtaggatctttttctgtaggatcaaccaagtagattgagacggatcatctacattgattttggcctcgctttcattgatgttgaggagttctatgatggtatctatcaaggtcctgtagtcaggatgccatgctatcttattcggagtcgccaaaagagcaaccatcagcaatcttaacacgaataattgctttcttttgtatcccaaaaggcgataaacttccgccatagtagagtatattttaatttgagcctcaacttgcatttccttcaattgtaattcgaacaatttattgctatagaaataaacttcaaaccttgggaacatcggactattagggatatctgacaaggccctgtgttggtttttcacaatattgtccagaacgtcctttgaaaactctgaactcttataacacgatgtcatgaaagttaaagtcttcagtaaaaactcgcaataaaccacttgcggagcatattcactattgtgcatcaaacttaaatcataataatacaagactttgtcagatatgcatttaattaataacgggaggttgatgttttctacatcaatatttaatgctggggcagataaagacataatggaatttctaggtgactgcatagcagctatagatatgctgttccttggtgtgcttgacgccgtcgtgcttgctgtggctttactattggaatctacaggcgaaatccccgttgagctagattcaaaattgagcttctccacaggacaaatgagactcacaatttgtggaatctggtatgacaaaccgagataagatagaagtaaaaagcagatcgaaataccgtcaagagcagaacccaaccataagtagtcacgcactttgtacaaagttgtgatcgcatcaacaaagctgttcaacgcatcaacgtaccttcctgccagcaattggaaattgcccaaaattttcatttgtctgcccaatgatttttgttgagacctattctcagatgtggaaagcgtggtagctagctttagagaagcggatctctttaaactattggtagtcatctcaaaggaagataacctcttagaagcagtagtaactgagcctgccttcgatgaacttgagacggaagattgtaccgctgacatgggtgtgctggatgacgaagatgtgtaactgttctgtcttattagagttgttttcaataccgcattcccaccaatcgcacccggcgacctcaaagtaacatgtttataggaagagtaatagctgttcaatgcggttaaaaagttccttgctatgtcgcacataatcgtttctatgtttttctgcatatctggagaagatgcgaatacattttccatcgtatctatggtttgctcaagctctttagtgggtgtagatgaagcgtacaccaaattcggtgaaatcaaagttggatacttctccttcatgaaattcaaattggtcaaggggtcactgtaatcgtttaccagcccaataatgacaaatgttttccgaaatggctcaaaatcatacagaaacaactccaatgcatcgtcatgatctatggtcaagaagtcgaaaaataacttcccatgtggaaagccttgcggtgtgaagatagggctgtcaatgggggttacatcagacagatgaatttcgttgaattcagaaagtttctgtaccgcattattaaactcttttcgcgtccaatggccaattggtatcactaaggtcctaatcttagatgggccaacatagcttgggaaatgcttaagaatattcatggtttttgtctccctgtaacaggttgtgagccgcaccttaaaccagttatactagaaccgtttaaactacaatctggcctgattttagttttgcaataacacgattaagcgtttacacatgcacattcatatataagtatacgtatttacacacattttattcgaaacctttaagatcgttttgtcacaatccatgatcatgatttacgacgcgagatgtttcgcgcctcactttgaagaatgccaaatataaaagtataaatatgggaactattcttatttgtgaagctgctgtaaaaccttatatgtagcttctacaatcgcgatgtgctcagcatcgtgtaccctttgctcgtactgctctagtgtttcttcgccaggtatgatttctagcttttttaccaccaatggctcacccttgtcgacctcctcgatgacatagtgcaccatgcatccggccgtcagaggcttgttctcgtcctgacatttgcgccatgccatttcaattgcgtgtgtggtaccatcgaaacaacctggtagcgctggatgcagatttaatatcggcacagattgcagttggctcaagaaagtagatccaaggatcaataaccagcccgcgcagatgataacgtcaggcttttcctcgagcactagttttgcgaggtcgttctcaaactgggatcttgccttggcccttgcggctttgtcctccttcgcaataccctttgtatatgggtatagcgaacaaacctttgtggggatattattgtccgctgccctagttaacccgtatgccttcttgctggaagatatgacagagacaatatgagcatcctcgcctaattggccctgcttttgggcatcgatcaaggcttgcaagttggaacctgagcccgaaattaatacgacaattctggccatagcttttggaaagattattgatgtgtgttggctctcacctgcgcttgctgcaagttaaatcatcaaccttgaggctaggagcgttattcaactttagaagtgtcttctcttcataaactactctatataactttcctcttgctggaataaaaaacaggtcagagtcactagcaacgagtcactcattcgaatccttgctgacgcttttagtctttatgctgaaatctatcttcgaagtcggaaggaaaatgcatttttaaactatcactagaactaccattttagagcgagcagaaggttcctcttttcttaaacaagtataattttcctttttggattgtactttatattcttacactaaacggcccctagatgtcacctgagctgtagtcaatgtatacacccattcaccgcaccagatagtaagttgaaaagtgtatcatctttaatatgaatatgaaagaatgaagtggagttcatccatatttcacaagaaaagaagactccaactcaaacagttgagtgttccatatacattctgtttcaatgataaatttagaggattactgggaagatgaaacgcctgggcctgatagggaaccgactaatgaactaagaaacgaggtggaggaaaccatcactctgatggaactgctgaaagtgtccgaattgaaggatatttgcaggtctgtatctttcccggtttccggtcgcaaggccgttctacaggaccttatcaggaatttcttgcagaacgctttagtagtaggcaagtctgatccttatagagttcaagccgttaaatttctgatagaacggatcagaaagaatgaacctttgcctgtttataaagatctttggaacgctttaagaaagggtaccccattgagtgctatcacagtacgttctatggaggggcctcccacggtgcagcagcaatcaccttccgttattaggcagtctcccactcaacggcggaaaacgtctaccacatcttccacatctcgtgcaccaccacctacaaatccagatgcctcttcttcttcatcatcttttgctgtaccgacaattcattttaaagagtctccattttacaaaatacaaaggctaatccctgaattagtgatgaacgtggaagtcacaggcggaagaggtatgtgctctgcgaaatttaaattgtccaaagcagactataatctattaagtaacccgaatagcaaacacaggctatacttattttctgggatgattaatccattaggatcccgaggtaatgaacccatccaatttccattcccaaatgaattaaggtgcaataatgttcaaatcaaagataatataagaggtttcaagagtaagccgggcacagctaagccggcggatttaacgcctcatctcaaaccttatactcaacaaaacaatgtggagctgatatatgccttcaccacgaaggaatacaagctatttgggtacattgtagaaatgatcactccggagcaactcctggaaaaagtattacagcatccaaaaattattaaacaagccacgttactttacttgaaaaaaacacttcgggaggatgaagaaatgggcttgactaccacatctactatcatgagtctgcaatgtccaatttcgtacacaagaatgaaatacccttcaaaatcaataaattgtaagcatctgcaatgttttgatgcattatggttcctacactcccaactacaaattcctacgtggcaatgcccagtatgtcaaattgatatagctttggaaaatttagcaatttccgaatttgttgatgacattttacagaactgtcaaaaaaacgttgaacaggtagaacttacttctgatggtaagtggacagccatattggaagacgatgatgacagcgacagtgacagcaatgatggtagtagaagcccagaaaaaggtacttcagtatcggatcatcattgttcttcttcacatccaagtgaaccgattatcataaatctcgatagtgatgatgacgaaccaaatggaaataatcctcatgttactaataatcatgatgatagcaacaggcatagtaatgataacaataataatagtatcaaaaataatgatagtcataataaaaataataataataataataataacaataataataataatgataataataatagtatcgaaaataatgatagtaatagtaataataaacatgatcatggtagtcgcagtaatactcccagtcataatcatactaaaaatttaatgaacgataatgatgacgatgatgatgatcgacttatggcggaaataactagcaatcaccttaaaagtactaatacagatattctaactgaaaaaggttcaagtgcaccctcgagaaccctggatccaaaaagttataacatagttgcttcagaaactactactccggtgacaaacagggttattcctgagtacctcggaaacagttccagttatattggtaaacaattgccgaacattctgggaaaaacgcctttaaatgtgactgctgttgataattcatcccacttaatctctccagatgttagcgtatcatccccaacgccaagaaacaccgcttcaaatgcaagttcgagcgctctcagtacccctcccttaataagaatgagttcattagatcccaggggatccactgttcccgataaaacaataaggcctcccataaattccaacagttatactgcatcgatatcagattcatttgtccagcctcaagaatcttcagtttttccaccacgtgaacagaatatggatatgtcctttccttccaccgtgaactcaagatttaatgatccacgtttgaataccacaagattccctgattcaacattgcgtggggcaactattttgtcgaataatgggcttgatcaaaggaataactctctaccaacaacagaagcaatcacgaggaatgacgtcgggcgacaaaattctacgcctgtacttcccacgttgccccagaacgtcccaattcgtacaaactctaacaagtctgggcttcctttgataaacaatgaaaacagtgtccccaatcctcccaacactgcaaccataccgttgcagaagtccagactcattgtaaatccattcattccaaggaggccttactctaatgtactgccccaaaaaagacaactttctaatacatcctcaacttcacccataatgggtacatggaaaacgcaagattatggaaagaaatacaacagtggttaaaaacgaggctaaaattggacggttccgtccagctctttcatgaaatattttctttgtaattgtgcatatgaccttcattttctataattttccgttcgaaaaagaaatattttcttcttttcaatactcaaaggcaatatcactgtttgcattcccctagcatttattacctaccaaatacagatgcacaagattagataaaatcttacataacacaaaaatccagtccataactaacacaatcattactattatataaaaggtattccgacaccaaccttattcttgtattctatgtattccgcgctaaagaactctatcaaatatttttcttccacacgaattctatcactgaaaaatttccaaagtacaaaaatgaaaataaccaatgataggggatttagaagcagtagctgagtgccaattgcccaccaaaagaacccaagataacttggatgtcttgaccaggagtaaacgccagttttcactaaaacatgatcggactccttcttggtcttcacaatatgagaaaaggaatgtcccgcagtatgcatagcaatagttctggtatattgtcccagaataactagaagacatccaagtactgtacaaagcttggtagctagagagtagctaaaaattttcagatcaggaaaaagaaagctttctacgaggcattccagaatagcaaaggaatgtgccgccatgtaacttttgccgttgttcagaagaaaggactctgaatgtaccttaagaggattgtatttagctgtaatataatactccaaaaaatggaataaggacagggcaataataaagaggttaaaattcttgaatctaatttgtggaaaaagaccaacaaatatacctaaaagaatccccagtatgtaggaagtcatggtcacctcatgcagcggattgcgtctgatgtctggatactcatgctcgtcttcttgaaaatcttggtgcatgttgtgttcaaaaacggtgaccacaatgaaagaggaggtaaaaagagtaattatcttgaaatcgattttcactttcttatataattcatcaacacgagaacctttctatatactggtggtatcatgtaaagaattgttttaccatagtggcccatttgtcaattcgtcttgagtgatgtttcattatcaatcggttgctatgccaacgaaaatactatgtcagactctcttgatgtatataatgaatggcaaagtacatagaaatagataaaagttgttattgtgagtcggaggggctgtttgtttgtcctactcgttggccgcggccttgaaattggttcaaattcgatgggccacttcttaattgacttccagaagctctgcctgaatctgtgccactggtttgagacaatgttgcaggggccgtacccaatcgttgacctcttccactaaaagttctcgtttctctttgcgaagatggcacattggcaaagttgttgttgaatgttgcagtttcattgtgggcacccgttatgcgagcatatagactagtaaaccaccatggcgttgagaatttcccattgggcgagattccgtaggttggatcagcttttctggatatcatcccccatattggccccagtgtatgggtatctaagcatgtataaaggtaccctgtagtaaaaccgatcaatgagattacgaaatcaccctcattaaaaacgaaagagataaacaattgaattaaggggaagtacttcccccaaacaggaatcaaaccataaaacatgatctgcacgttggcattgtcgatcgaccaagtatatgtaatgcatgatatgaacccagaggtgagcacaacagggtagtaggacccataaatgattgtagtggccgtagtgatggctagtatacaaaagcacaggtagtaggcatagtctactgttaccatcggtcctcgtctattggacaaaccgggaccaaaatgccctcgctccaactgtgaggacctgtcataaatactatatagttccattagcgcaggcatggcacgagacgaaagcattacacaagaagtaagaagtctccatatctgaaccttcttgaacgtcaaattccaaacataaataaagtaccacggattgattagattcaaccggccgacgatcgtcataacgatcgctagagtaaataaagttcttgttattggggggatatttaaccagaattcttttgggcccatcacatcattattacggcctccatttccatgtaatgtacgcacattccttgggcctgccattatttcctcgaaaatagtttttgatttgacttggaaatgcggaattcactggtaatttgttgtattttgccttatatcctttgtttgatactcttgtcttatattgaagaggacacgatttcatgagccgcgaacgggtaagtagggacttttcacatttgaaatttttcaaatgtgatgaggatcgattctgcaaagcagcagataatagcagataaaaaatagagagttgcaatattcaagttcctggtagctgctcgaatcaagaggggtgaattaaaggttttcgatttttgctatggctgttcacaccaataggcaaatccttacaagaggcaaaaactatgctacaaagcaatcaaagaaattcggtaccgatgaggtgacgttcgacaaggattctcgtttggattatctgactggctttcacaagagaaagcttcaaagacaaaagaaagcacaagagtttattaaggagcaggaaaggcttagaaaaattgaagaaagacagaagattcggcaggaacgtaaggaggtgatggaagaacagttaaagacgtttaaagagagtttaaacttggaagctgagatagaggatgcgaaaaatgataagacggaggatttgcaggtagaatctgatgaatcctggcacgggtttgattctgataaagatgacggcgataacgacaataatgaaagtagcgtaaagcctattttgaagaaaggagcaatcacggaaatatacgatgactcaactactgttgaattggagacattggaacccaatgataactttgaatatttagcccagctaaataatgtcaaattagaaaaggcagaaaaagtactcaaacaaagcataaatagagccaccaaatacgcgaagtttctgggcgtggatgagaaacaaaagaagaagccaagagtaaaaaagttcagatatttgaccaaaaatgaacgaagaataaaccaaagaaaggcaaacgacaacaagcgtaggagataatgcagtcgcattatcgtcgggcaccgcctggggtttcttgacgctcaaacagtgtttgatttttttttggaaaagtatatactgtgcatatgtatttttcgtttattatatgtaatatatcgaataaaccattctacggggaaaatagaacaaatatttacagcatttgcatgattttatatggcttgcccaacaaattatttgcttgcaaacttaatataatactctgcgtccaatttgaaaacgacccatatgcctcttctaattacttcgaaatactgcatttcgccttggaaaaaaatgtagtcgctatctgcggcaactaatttcagattctgcgataaatatacccatagccaccagaacctcagcaaaaagtcaacgagaatcgccgaatgatacatttttttctttaatgtgacggcacttttggatctggatcttaaagaggttaacgagtccaatgaccaatccatccttacatcccaaaataacgtataggaagaattaattagcataaaccatctttgaacgtggtgtagtctttcttcgttgatggatccctcatacactcttgatctccaggtgcaaaaaagaatgggaagattacaactgtatttcaatgcattgaatagtaaagttgcttcgtgcagtaaacggtattctctcaaacactgcagtagtcttaccagtacaggaagaagggctacggatagatcaaaatgtgtgaagggttctctaaaaattagagaggtaaacaatgtgaagtctatcaatggttttccaaacgatgtcaacgtgtcagagattaaaatgtaggtattccttaaggaacggggggaggattctatcaacaaacatctcctagtacaatattttattatctggcactctttcaacagaaaccaaaatatagtgacacattggatcaatggtagaaaatatacgatgagaatgatatttttgagtggaccttctataatattcatgaactcaaaaaggaacacagtggcaaagtggaacggtataataatccttgttatcttcaaagcaaaatttctagctgttctatgcaattgctgtagagtataacctggacgtatatcgtgcggtactctcgtgagtatgacttgggatacgtctaaattactatgcaagaagaattttaatatccatgtccagatccaaagggcaagtattatgagcacaataaatcgctgcggagggggaacatttaatatattttggagataaagtccttcagaattactttcgcttttctccatattttgcggcccaacttgttgcagaattgaaaactttgtataatactaataataatttataataataacaataataatttataacaataataacaatgccaaacaatttatatgggtaaccagtttttggtactgtttgccatcaatattgcgactaaatcgggagcggttagcgctggcttgcactttttgcaactgactctatttctttcattgattatgttattttcagatgacgaaatacgccaaaaaaattcgggaaataaatactagcgtgatatcggtttaggtatattacaaaagaacaccaaggtaaggcatcattagttatgtatgcatattactgacttttaccaagcggaccatgacccgagttcaatgattacccctaatacaatttttgtgtgttccgccatatgagcgagacttaatctgtccaaagtatccatggtgctgtgaatatacttgttagtctttttgaactcactttcaatcacgaaggagcctggaaatccgtttctggtggcactcccatgatcgctacaagcatagccacattgtgtatccctgtaaggaatggatagataagagttgataattagttttataaaatcagttaatgcgggagtagtgtagtcggtgacaatccccacatgttcatcttctggatcagaaacatatcccgtcatgtcttgctgaagcatcgctctcacatgctttttctgtttggcataagctgtaaaaacatcaagagaacccaacaatcccccctcttcggcggaataaaagtgaaattccacagtgttgttaggtctaaatcctctcttcaaaaaattttccgtatataatctgagagcctccatattagtcaccgtgcctgacccattgtcgtccgcacctggagctgccattatggatggcagtagcagattgatagaatcttgatgagaaccaattattataatatcttctggcgtagtagatcccgtgacacggactataattgaatattgcttccattctttgtgatcaaaatgttcaatagtcaacgtatcttgcggaatatcttttgtaatattagcgatagttgcagctaaccactcggcagattcaaagccgtgatcggacttgtagtaacgggtgtaaaaacttgtaaactttgccaagttcttgtgcatagagcccttgtctatattcttaatcgaatcatccactacttctttgttcgatatctcaggaggatagttatacgttggtactgttggctcttcctccttgttaaagaaaggtaagaaagaagtgtgtttggtcacatcaaagaatttgacacctcttcttcgtaagtttagcttttctgattcgggaacctccattacctcattctctcctacttgtaaaacccttaaaggctcatatggatatgaccatgcgatgatggcaacattaaataaaacaaaaagcgactgtatcctcatattgtgctaatcagcggttgattatgttacttactttttcgaataaagattttgtatttctttagcttcgaagattgataattattgaatatcaagtttcagtttactatagcggtccgaacatatgaaagattttagtaaagacgctggcaagcttttcagtcaaaataatacaaaaggaaatagatagaaaaaaaggaaataatcaggcctccatattggactcaactatccttcagtaccgcaaaacttattgtgtccatatatcctatgtcagcatacatcgcaatgaaaggagtaataacaaacgtcgatgagaacataagaaatgatgaagatgtggcttttgagtacgaaatacaaaagacaccgcagaacatacttacatggaaaagatatatcgagtattggaaagaggagggaagaactgacaaacagattaggtggctatatgaaagattttgttcacaatttgtaacagatacaagtatatgggaagattatatacgctgggaatcaacaaaggaagtagtcgaaacttcacgtattttctggctttttcaaaggtgcctgaaaagctgtgtacgagattgtgacaggatatgtttgtcttatttagaattggcaattgaacaatatgacttggcaatgataaggcatgccttagcttcatctttaatgaaaatggagagagaaatgcatcggaaagtttgggatcctgtcataaaatttgtggaagaaaaagttttaccattaacgcaactggattcaactcaagaagatgaagaagaaagtactgatgaagctgaattgataaatgtacttttagtgaagggtttcacgaagggaggttttattagcgaggaaattagtgaaaacggaagtagaggtgatatttggtcgtcacatattttagaaagatacttaaaagtggctcctcagcaaaaacgaaatgaatcgctggcaactcttgcattaactagagacaatattaccatcaaatcagtatatgaaaagtatttgccacaagatgaaaatagtgggaagtatctacctagttcagaactgccttttgaattaaatttcaattatttggccagcctagaaaaactaggtttagataatcaatatgaggagttcatgaggcaaatgaatggcatatatcccgacaaatggctttttttgatcctatcacttgccaaatattatatctctcgcgggaggcttgacagttgtggtgatttattgaagaaaagtttacagcaaacacttaggtacagtgattttgatcgcatctataatttctatttgctatttgagcaagagtgctcccaatttattctgggaaagctaaaggaaaatgacagcaaattctttaatcaaaaagattggactgaaaagttacaagctcatatggcgacatttgaatctttaatcaacttatatgatatctatttgaacgatgtcgcactaaggcaagattccaacttggtggaaacgtggatgaaaagagtgtccttgcagaagtcagcagcggaaaagtgtaatgtgtattcagaagctatactgaaaattgatccccgaaaagttggtacgcctggctctttcggtaggctttggtgttcgtatggggatttgtattggagatcaaacgcaattagtacagctagagaattgtggacacaatctctgaaggtaccgtatccttatatagaagatctggaagaaatttacctaaactgggctgatagagaattagataaagaaggggtggaaagagctttttctatccttgaagatgcattacatgtgccaacaaatccagaaattctcctcgaaaaatataagaatggacacagaaaaatacctgctcaaactgttctattcaactcattacgtatttggtccaaatacattgattatctagaggcttactgcccaaaggatgcaaattcctccgataaaatattcaataagacaaaaatggcatacaatactgttattgatttgagattgatcactccagcaatggcagaaaattttgcattgttcttacaaaatcattacgaagtcatggaaagttttcaggtgtatgagaaaacaatccctctgtttccccccgaaatccaatacgaattatggattgagtatctagaagtagcgacatcacatcaattgtcatcactgagtcctgaacatattagatttttgtttgagaaagcacttaagaatctatgttcaaatggtatagactgtaaaacaatttttatcgcttatagcgtatttgaagaaaggataagtggtctgattagcaagagtattgagatattacgtagaggtgctgtaataggtactgttagtgtgagcacgcacctcgaaagtagactgcaactgtggagaatgtgtatttccaaggccgagtctactttgggaccatcagtaaccagagagttgtaccaagaatgcattcaaattttaccaaactctaaagctgttgagtttgtgattaaattttcagatttcgagagctctataggagaaactattcgagcacgtgaaatccttgcctatggtgcaaagcttcttcctccatccagaaatactgaattatgggatagctttgaaatttttgagttaaaacatggggataaggaaacttacaaagacatgttgaagatgaagaaggtgttggaatccaacatgctcattgattcagctagcgttagccatgaggaaggtaacattaacttcgtggcggcagcaacctcgcatgctcccaactcgcatactcttacccaatcaacctcttcatattcgattaatccagatgaaatagaactagatatttgatataagctatgtaaaatcatgcatcattttcgaaaccataagttcttttttggtgcggccttctgcaattactgattaagtagcaattttccttcaaacatccgtgcactgtggatgtttgggttgtgtattttgctttcataacatacagatattttgtttaaggaagtgaaataaacaatatcataaaacaggtacttcatagaccataaagcataacccagattatcctcttagatagcaatgctaatgtaaacagagatccgtttgcgtgactttatactaatatgatatgtctacttcgctttgtgttcgagcagcctggcagtcccctctagccgcttttttccctttccgaaggtttccgcctaagccccctggctctaggccgagaaaatgttaatgctccttctacgagaaaatgcttgtcgccacaccaggacaggtgctcgacgacgcttccgctaatctttctcaatgttgtatcttctttggcggtacattactagtatgaaaatggaataaaaacagtacctaaattatttacttacttcccgttaaagcaaccccaagtgcccaatagaaggataaatcaatagtcaatatgcctccaaagtttgatccaaatgaagttaagtacttgtacttgagagctgtcggtggtgaagtcggtgcttccgccgccttggctccaaagatcggtccattgggtttatccccaaagaaggttggtgaagatatcgccaaggccaccaaggaattcaaaggtatcaaagttactgtccaattgaaaatccaaaacagacaagctgctgcttctgttgttccatctgcttcctctttggtcattactgctttgaaggaaccaccaagagacagaaagaaggataagaacgtcaagcatagcggtaacatccaattggatgaaattattgaaattgccagacaaatgagagacaaatccttcggtagaactttggcttccgttactaaggaaattttgggtactgctcaatctgtcggttgtcgtgttgatttcaagaaccctcatgacatcattgaaggtattaacgctggtgaaattgaaattccagaaaactaaggttgtttataacatcaaaaatccattccatatattattctgtacttttaatttaaaaggctttaatctaacatataaaccaaaatattttacttcacgttatattctttttttttactgttgcagcaaattgtagtccggctgtgttcaatcaaccgtctacatgttgaaatagatatttccatctatgaaatgggccaaattgttcatcgacgtaaatatcaggcaggtttctagtatttgacccttctctttgcaaattttttgtcttgacatccaagcttcctgaaacccatctttcacttgcttgtattattgtagaattatttcaacgataccactcataactaaaaaggctatccttctttgcatgtagccaatgcattgaagtgttgctattgtccccgttcaggctctgcaactggataaaatatcttattatggtgacggattaaaattattcaatttaaaaatccttctgcaaatacaaaaaggaacttttgagttttacgtattcttatgtattagagtagagaatattttaaaataataaactaagatagtgtgtatcagttgttattttatatgtggtttatgttcattttttttacttctctttcgttaattccattttcattaactaaatatatatttgcctgaaaaacattatgtgcatggccttcttttctaattgaaaggtttacatacatcaatggcatgataggatgttgcaactttcaatctaaacatggttgccatataaaatattactctaaaaatgtactaaggataaaattaaacgctacctaatcctgccgatcataggatacctattgtatgttcaagaagaagaaaataggttcaaattaatagttcaatttaaacttcgagtccattttacaatattagtttaattttgggcaattcttataatttcggattaactaaagtacctatataattataccttatcgcggcgaaaaaagtataaaccacttattgtagtcttctagcgcaggcctgctcatttttgaacggctttgataaaacaagacaaagcatgtcaaaatttacttggaaggagttgattcagcttggttcccccagtaaagcatacgagtcctccttagcatgtatcgcccacatagatatgaatgccttttttgcacaggttgagcagatgcgatgtggcttaagcaaagaagatccggtagtctgcgttcagtggaattccattattgcagtctcttatgcagcaagaaagtatggtatatcaaggatggatacgattcaggaagcactaaaaaaatgtagtaacctcataccgatccatacagccgtttttaaaaagggagaagatttttggcaatatcatgatggatgtggatcttgggtgcaggatcctgcaaagcagataagtgtggaagatcataaagtatcactggaaccatataggagggaaagtcgcaaggcgctgaagattttcaaaagcgcatgtgatctagtcgaaagggcgagtattgatgaagtatttcttgatttgggccggatttgtttcaatatgctaatgtttgataatgagtacgagcttacaggcgacttgaaactgaaagatgcattaagcaatattcgtgaggcttttatagggggcaactatgatataaattcccatctacctcttatacccgaaaagataaagtctctgaagtttgaaggcgatgttttcaatccagagggcagagatctgatcacagattgggacgatgtaatacttgcactaggatctcaggtatgcaagggtatcagagatagcataaaagatattctcggttatactacttcgtgtggtttgtctagcaccaaaaatgtttgcaagttggcttctaattacaaaaaacctgatgcccaaacaattgtgaaaaatgattgtttattagattttttagattgcggaaagtttgaaattacatcattctggaccttaggcggcgttcttggcaaagaactaattgacgtattggatcttccccacgaaaacagtattaaacacatcagagagacgtggcctgataatgctggccagcttaaggaatttttagatgctaaagttaagcaatctgattatgatcgctcaaccagcaatatcgaccctttgaaaacagcagatttagcagaaaagttgtttaaattaagtagaggccggtacggtctgcccttaagttctcgccctgttgtaaaaagtatgatgtcaaacaaaaatcttagaggaaaatcgtgcaattccatcgtggactgtatttcttggcttgaggtcttctgcgctgagcttacgtccaggattcaggatctggaacaggagtataacaagatcgtaataccaagaacagtatctatatctttaaaaacaaaatcctacgaagtatatcgaaaatcaggtccagttgcgtacaagggcatcaatttccagagtcacgaactcctaaaagtaggcataaaatttgtcacggaccttgatattaaaggaaagaacaaaagttattaccctttaacaaaactaagtatgacaattactaatttcgatattatagatttacaaaaaactgttgtagatatgtttggcaatcaggtccatactttcaaaagctcagcaggcaaggaagatgaggaaaaaactaccagctcgaaagctgacgagaaaactccgaagttggaatgttgtaaataccaggtgacttttacagaccagaaggctcttcaagagcacgcagactatcatttagcattgaaactgtcggaaggcttaaatggtgctgaagaatcatccaaaaacctttctttcggggaaaaaagattgttgttttcacggaaaagaccaaactcacaacatactgccacacctcagaagaaacaagttacatcttccaaaaacatcttatcattttttacaagaaaaaaatgacctattccaaatagacaattatatggcttcagcaactaaaacgtcctgataatattgcttttccaaaatttctaaatgattcacgggcgccaggttttgttgataagaagaacgaagtacctttaatatcttatgatcggaaaataccgactgatgacttttgagacttcgcttttgatcaaagtgataacattatgtacaatattcatactaggatttcttgatagagatttggaagtctataaaaaagaaacaacttgttataatttatttttgtagacatgactcacagaatattacataccttcataatatataagatccatgtgataatgaatgctggaagcatgatctctgacctcagctgattgttcaggggacttaatcaattagatgcgtttaaagcaggaattggtttgatacacacaatctcatgttacaaagtaacgctgtttaaaaacaaatctgaagaataataatgcaagtaatattatacatcataaaaaagttatacactatcattactcttctgaagaccagattacaatacaaattaaggcaacttggccgagtggttaaggcgaaagattagaaatcttttgggctttggcccgcgcaggttcgagtcctgcagttgtcgttatttttaatgtttttatttggtagcaacaaaatttgtcagtcaatttcttttgtttttttctttaaaaggtgtaacaacgttatcactcaagtattcgtttcttattatcaaaagtcttagactttctattaatagcagtttgttcttttccacaacgcgctaaagatatttcgctttctgacccgtttggttgcagaaaatttttttaactaatttaggaatatttagattagttaattggagggcttattcaaagacagtagttacagcgatttaaaagcagtgtccctcgtaggcacctgtagtcatttcattcgtttggatatttcgctgtactgcttcctgcattgtaatcaagagaaagtttacaacttagagcactaactttgtttgtaaacattttccgtttataatcaattgccatatcatcaattttattatcattctttaaccagtaactaactgattccgcacccacattattgaaatttttgcgatatctttttcctcaactgacgcagtcaacagtcagaaacagagaatgtataaagatggtctcattgaaaataaaaaaaattttactcctggtgtcattgttaaatgcaatcgaggcctatagtaacgatacaatatattcaacttcatacaataatggaatagaaagcacaccctcatattcaacatccgcgatatccagtaccggatctagcaacaaagagaatgcaataacatcaagctctgaaaccaccacaatggctggccaatatggtgaaagtggaagcacaacaataatggatgaacaagaaactggtacgtccagccagtatattagtgtgacgacgacaacgcaaacttctgacacgatgtcatcagtaaaaaagtctacggaaatagcgacaccaagtagtagcattgtacccacccctttgcagtcctatagcgatgaatcacaaatatcacaaacgcttagtcacaatccgaagtccgtggcggagtcagatagcgatacaacctcctcggaatcctcaagtagcgtaataatatccacatccgatagttcagcggtaccgagggaaataagtccaataataaccacagattctcaaatttccaaagaagaaggcacattggctcaaacttccagtatcagtgaaacaacgagaattgcacaaatggtaaccagagtttcacaaatctccagcataacggcagcttcaacaatagatggctttagtagtgaatcaacacaaacagatttttccaacactgtatcgtttgaaaattcagtcgaagaagaatatgccatgagcaaatcccagctctctgaaagttacagttcaagttcaaccgtctattctggaggggagtcgactgcagacaagacatctagctcccccattaccagcttttcatcttcttatagccaaacaacgtcaactgaaacctctgagagcagccgagtggctgttggagtatcccggccctctagcataacgcaaactacatcaattgatagttttagtatgagtgaagtagagctttccacatattatgacttaagtgctggcaactatcctgaccaagaactgattgtcgatcgcccggccacttcttccactgccgaaacatcttcagaggcaagtcaaggtgtaagccgtgaatctaacactttcgcagtatcttcgatttccacgacaaactttatagttagcagtgcttcggatactgttgtttcaacttcaagcaccaatacagtgccatacagctctgtccattcaacctttgttcatgcgacttcctcgtcgacttatatttcttcttccctttattcttccccatccttatctgcatccgtttcctctcactttggcgttgctccttttccatctgcttacatatctttctcatcagtacccgttgcagtatcctcgacgtacacgtcttcaccatcggcttctgttgtagtaccttctgcctatgcgtcttcaccatcagtacccgttgcagtatcctcgacgtacacgtcttcaccatcagcacctgctgcaatatcctcaacgtacacgtcttcaccatcggcacctgttgcagtatcctcgacgtacacgtcttcaccatcggcacctgctgcaatatcctcaacgtacacgtcttcaccatcggcacctgttgcagtatcctcgacgtacacgtcttcaccatcagcacctgctgcaatatcctcaacgtacacgtcttcaccatcggcacctgttgcagtatcctcgacgtacacgtcttcaccatcagcacctgttgcaatatcctcaacgtacacgtcttcaccatcggtacctgttgcagtatcctcgacgtacacgtcttcaccatcagcacctgctgcaatatcctcaacgtacacgtcttcaccatcggcacccgttgcagtatcctcgacgtacacgtcttcaccatcagcacctgctgcaatatcctcaacgtacacgtcttcaccatcagtacccgttgcagtatcctcgacgtacacgtcttcaccatcagcacctgctgcaatatcctcaacgtacacgtcttcaccatcagtacccgttgcagtatcctcgacgtacacgtcttcaccatcagcacctgctgcaatatcctcaacgtacacgtcttcaccatcggcacccgttgcagtatcctcgacgtacacgtcttcaccatcagcacctgctgcaatatcctcaacgtacacgtcttcaccatcggcacccgttgcagtatcctcgacgtacacgtcttcaccatcagcacctgctgcaatatcctcaacgtacacgtcttcaccatcggcacctgttgcagtatcctcgacgtacacgtcttcaccatcggctcttgttgtcctgtcatctacttccacatcctctccatatgatattgtttactctccatcaacttttgctgccatatcatccggttacacgccttcaccttctgcttctgtcgccatgtcatctacttcctcatcctctccatatgatattgtttactctctatcatcttctgcttccagatcgtccattgctacatatgaattttcaccttccccatctacttctttacccacctcttctacttacacatacttttcatctgcttatgcgtttgaattttcttctgagcggtactcaacaacatccacaatagcaccaactcaaatacatagcacattgtccaggattacggatttcttactgcagacttcgatggcaatccaaagtatagtctctcagcaaatttctacaagctcaactttaaatgacgaaatacattcaagcgcgctttccgttttcaacccttcagcttcgaatttggttgaaacttctctgataatttcatcgacccaagcaagcataacaagccccaaaaactcagctaaaattagttcactacagagccagctgtctagcagtacaaaaaatccatacgatacggcgaacaagaatactgagaccagtggcagatccacagttgtttcgaatttcctatacacatcttccgcggcgaaaccagacaatgaaaagttttccgctactcctacagagataactacaatttcaagtagctcgcacgcatattctttatctattccaagttctcataattctgtgactggactatcacataactttgtcgattcgtcaaaaagtgcaacctcatttggctactcatcctcatcaatatcttcaataaaactttcaaaagaaacaatacctgcaagtaaatctgtttcaaacacacaagaaagaatcacaagctttacatcaacattacgagcaaatagtcagtctgaaaaatccgaagggaggaattctgtaggttctttacaaagttcacatatttcatctaacccatcgctctccacaaatacaaaggttgattcgaaaagtttatccaggaaagtatcgaaaaccatgggcgaaaatggcgaggaaaccggcttaaccacaacaaagacgcaatacaaaagttcttctgaaaccagtgggtcatattctcggtcttttacaaaaatctcaattggacctgctacgactgcagttcaaactcaggcaagcactaattcagtattcacagcccctgccttgtctacctatcctactactccgtacccctctccaaatagttacgcatggttacctaccgctattatagtggaatcatccgaaacgggccccactaccgcatcattcaatccgtcaatcactggttcacttcccaatgcaattgaaccggccgtcgctgtatcggaacccattaaccacactttaattaccatcggattcacggccgctttgaattatgtatttttggttcaaaatccattatcttcggctcaaatcttcaactttttacctctcgttttgaagtatcccttttcaaacacctcatcagaactggacaatagtattggggaattatccacttttattctttcataccggtctgggagcagcacaactaccctttccccaaaatccatatcatcattatcagttgtcaagaaaaaaaaaaaccagcagaaaaaaaatgccacgaagtcaaccgaggacttacatcctccacaagtcgacacatcctcaatagcggtgaaaaagattgttcccatggtagactcttctaaggcatacattgtatcagttgcagaggtatattttccaacagaagccgtaacatatcttcagcaattaatccttgatgaaaattcgactctttatagcaatcctcaaaccccactgcgaagtttagctggtctaatagatagtgggatcccattagggggattgacgttatatggctctggagatggtggttatgtccctagtttaacctcatcaagcgtcttggattcttcaaaaggaaattcccaaaacatagatggaacttacaagtatggagctttggatgactttatcaattcattcacagattctgcatctgcaggaaagtatgctgtaaaaataatcatctttttgattgttttaactattggcgtactcttgtggttattcgttgcattttttgctttccgtcatagaaatatattattgaaaagacacccaaggaactgcatagggaaaagcctcaataatgagagggaacttgaaagtaccgagctttcccgctcttcttctggaaaccaagtttataatgaaaagccgccagaatctgaaaatgaaagtgtttactctgcggtagatgatcattatattgtgactggcgaaaacacagtctataatactattcacagattacattataccattaatgatgacggtgatctattgtacagggacgcaatccccctcgattttgatcaaaccaatggggatgatggttcgggaatagacagtatagtaagagactgcgtgtatgacaaaaaccaagatgctacggaagccttcttgaatgatgaggagtccatatcaggcattctagatgttgatgaaaatggtgatattcgattatacgacagttattctgacaatgaagagtcaaacagttttcacttgccagacgaagttattgaaaactataacaagaaccatttgtgcgaaactaaacttcatggactaggcactgaatcatgtactacagatgatcccgatactggaaatcaaattacgaatgagttttctacagggagtcagacatgtttgccaagtaccgcttataccacaccccttcatacaaattcgattaaacttcacacattacgctacacagaatcttcactaccaaagccaaatcagactcttttctctaatcttgaagatttagaaatagaggatattgacgacaatggtagtgtttcagatgtacatatcgaggagctggatgctttagacgaagaactttataagagaatgtcgaaagttataaaacaacagaaccatcaaacgacaaaaatatagcgaaaaatgattattgactgtgcaataaacgctgctggaaggggcgcttgcaacaaaagatgatcacaaaaattgatacccattaatacacataggctcacgccattactattattatatatatcatcaagtattgcatttgtaattttatgagtccttcttagtaatacatgaaggcttttttttaatattttcggaatcaacgagagtacactattctatccgatgataaccgagataaatgaagatagtaactaaccaatgaaaaaagagcgagaataaattaaagcaataatatcaagttagtcgtgggaatatatgatccacgcataataaggttacattaagcactgctttatcctctatgtctgctaagaaaaggccttcgggaaacgcagcatttgaacttccaaaacggagaagaacctaccaagcttgcatcagctgcagatcaaggaaggtgaaatgtgatcttggtccggttgataacccacacgacccaccgtgtgcacgttgcaaaagggagctaaaaaaatgtatttttagctctaataagggaacttcgaacgacttgcctcctaattcgattaatgcaataagtctgccatctctaggtaagagtaagcaagagatacaaaatgactcaacgagcccaattttatcggatgtacctttgtcaagaaaagggattagcagtgaaaaatcatttaaatcagaagggatgaagtggaagcttgaactttcctccatgcagaacgccctagagtttctggcccaagctgctggaactgtagcaaaagaaggcgcaaaagaaatcataaaagagaagtccacaacaccgaaaccactgaaaagttctttggatgcgacaaataaatctgctacggacgaggggttgaaacgactttcaaaaagtgacagtactaacacactttacgaaaatacagcagatatgcttaaccacacgctgaatacgaataggaaaacatcacaattaatggaagaaatcgggaaagtgagacctccacctacccggaaaattgacgacttcgattacatcggtccagatagcttgcttactaaagaggaggcgattgaactcatagaggcattttttctcacgatgcacccattctttcccaatatcccacttcaattgcatgatccgaaagaattagcagaatatccaattttgttttgtgcaattttgactgtttctgctcgctatcatcctttcgatactttaggattagacaatggagaagatgggatgagacacattgaagttcacgataaattatgggtgtattgccagaagcttatatctcaaacaatttgggcagaggctagtactaggtcaattggcaccgtgcttgctttcataattttcacggaatggaacccaaggagtatccactataaatggtctgactatgcaaatgatcctgagttaaataatgtcaacgctagaggaagtaagaatattagtacgaggaaggacgaagaaggattgaccggtgtcggcgcaatccgtagaagcgaccgaatgtcatggatgctgacagggtctgcagtaaggctggcgcaagatatgggattcattgaaaacagctcaaaagtattcattgtcactcatatatctgagactaccagtgctatgaatatgaatcaaagatccttattagcagaatcattcagcgttttaaacttgaatttaggaaaaattgaaaacgatggaaatgaaagcaatgaggattaccttgggaatgaaaaattttatctgaatgagattttgcctgatgaagaaagtaaactaaggtggaagagagtttttgaaaactcagaaaatgaccacgacaacgagaaaaattttttgactgattgggagagggagtttttaaacgatgagtatgttctatattattctaataaaaaagatgatactaatctagcacagaatcacataccaccatttccactaagattctcattcgcccaaagagcaaaaatagagatcattcgaatcctatccatagcatatgagacgatttactgtgagaagaataagaggaaattggcaacgacagatcagagacacaacctctctgtcctaagtgttttttctcccttgatagagggctggctcagtaactacagagagcttcttgtacccctttctgatgtccctttctcactagcagataggaagaacaaaaaacaaatatttgataacatcgatagaataaatggtgaaagtattatcacagatttcaattattgtcaactttatatcttttccctcgcactgcaagtggatgggaaaacaagcagattgaatatgaatgaaattgtgacaagcgcgaggtatgtggaattagcatacagatctgcaaaagaaatattgagttctgcaaagcgagtttcaaggcaaggaatgctaaaatacatgcccgtaagatgggtaatacgaataattagatccattgcgttcatagtaaaatgctacctaacacttactggtagtgaactggcaacaaatccagatgccagaaacattttaaaattaagtgcaatatcggttgacgaaacattcgatatcatccgtgacactgcggttactttgaaagaagctacaccagatgaattacatctatgtcaaagatacgcagccatattaatgtacttatgtacagagatgaaacttcgaaaaaaatcttacttagaacgaccacccttattaagagatggcaccactcctctagagagcaatcgcgaatcctcactggagggacaagacttaactaagaagccaatattctctaaacgtattggatataataaaaccgagactacttttgaaccctcggaaaggcctttgacggaggaaattaatagcaattctcagaattcaaatgatacatcttctaaaggtatcgttgatccttttgttgaacaaaacaacgatatcacaacagcgttactgaacaatgaactcttccaaggtccatctctatctgacgaggttacagattggttcggtgctagtgaagatatcgggcttgaatttgtagaaccatggacagaacttattgagcaacgatatatgcaatgtggagatggtgataataataatttcgaaaatttatacaacttgttcgtgaatagtaataacatcaataatgatattaataactcaaggccaataacgcgtaaataagtagatatcaaagaattacgtcatcaaccaagacaaccgcactattcgtaaaaatgattttaaatacaaagacagaataacaggggaagatggaggtatataataatgcgaatgcttcataatactatgactggttttccattgggcatatgagatgattttacggctcaatcactacttatatatgatttctataacaaagcaggccattacacattaggaacggctatctattacataagaatatgcagcaaattcgttggatatgttaaagtatattccacgcatgctgagaagtggattgccagaaacgtgacgtgaaatacctactagaacaaaaaaaaaaggaatgcaaacgttctaggagccataggaatcaaaaagaaaaaaattgaattaatagagttcgtgagaatcattgcgaattgagattctaattactgatctgagacttttgtgttttataataacaaggtgcataaactacttgagtgataaatttcccctcatatctagtagtgcaagctacgctgattatttcatctctaatactgcttgtcagtaaatggttcaaattcacgtggggtataatatgatttatcgcaccttcatccctctcatgtgattctgaattctgattgctttggtttagtattctgttcagataggatgaattcaggtatatgggcaagtcaggaactgggtatctacttagaaaaaccgcctctgctgtttctgcatcaatattaccgccttgctgtaaagtagcaaataaatcatcttgattacagtcaacaactctatgtgtaaagctgggaggttcttggggatgcacgtcatcagaatctccttttacagaaatcgtagagccgtcacctatattaaataaatttggtatttcgttcgaatacaccaacctctcaggcttgacctcggccatcaaatccaaactgctagccttcagacgtacaaatgagtcacgcatatttattgaactggacctacttaagcctctataatctgaaaacggtgtacttggcctttcaacacccttagcagaatagtaggaagattttcgagaggaagaaggaaatcttttaagttccggtctcttgggcaattcttcatccagtgttggctctacttgcgagtcgatgtctgcttcgtttctaaatggctcgatcgtatgataaccgggcaatacttcaaaccagttgacaaaattgccttctgaatccgtagctgtaggaagaaaatttgagtgagtcaatataccattgatggagaattgcagtctataaattcctgcaggcaaaaaaagatctggaacaaaccattccttatgcacatcatcataaaccatgcggatcctaggatttaactgtttttctgagtctaaacttgcattctcatccaaggtaagctctctttgctctttaagagcagaagcaatatccgtgcttactataaagacttccgtggttgcagccacggtaccatcgtctttccattttagaacaactaaagtattttcggtggagtttgttgatgatattgaagacatactcgacatggaattagagtgatgcgatatttctctatgctgcggtgcagagtattgactttcattgtcgttaataattggatgtagtggatgcaaaggctgcaaattcaaaccgtttgttaagatactctttcttgattgtaaagaatgcaaagaagcaaatgaggatcttctcgaatttgaaaccgaccttatttttttattctgggctttctttgtcttattatggtgcttatttaaatctctttccatcaaggtcttatcaccgtacagtttcatcatcatttttgcagtagcagatataggtgcggtaaaatcgtcgttggagcctcccgcgtttcccttgttacgggtgttattttcaatatttccattgttattagcgtggcttatcctttctgcagtatacattgaattagaggaattcacccttgaaagacgttgcatatccttttttaaagcattttgtaaaagagactggttcaaaaccatatcttcactttgaagtacgcctgcttctgcatctacactatcactgtttccctctttatccatttgagagttctcagaaaatgtttcgtcgttattgagatattgatattggtatgcatggatagatggtttctttgaatagggttgtcttacaggaatatcaatggaatccgtcttggtcaaggcgggaagtgatgctgaatgcaccgatgaagacctcgttggagaaggggaagcagtagctgaactttctaaaagattttttttcaaagctatgatgcttgagcgatgcctttcatggtgtggtttgtcgtttctttcattttctgttgtttcgtcaaccatggtgtaattcaaagtagacagatcatccagatcacttttagttcgtttgacagtggccattgatggacctgggctcaaaaacgacggagatttcacctgctcttcgggtgcacccacatcgtgatcatcacttaaagtcaaattggccaacgtagtgtcatttacgtctgcggcagaggacaaagaataatcctttttgaatagatgggacgggcccttatcgatagtagtatcactgctcatgcgcccatcacaatctgtcgatggatcgtgagatgcaagtaattgcattctagggggaatggcaccattatgttcgctagtatgactggcgcgtctcttatgagtactcttcctattgttaaacagttgagaggttatgcttccctgacgatctttattgaatgcatcatgaaaatgatgtccatgctcctttttggttgaatgcgatggatcctgagtagaaggactgtttcccatggcggctgcaacaactatataatatgacagttcaactttccaagatgtcagtccacacgcaaaaaaagaagtgcaaatgaaagaaacactaggtaagacaccttgtttatgtaggtatccacttgtatcggatatatctaccattgttaattgtcaatagtattccatcagagacaatggtaaaaagacaaaaaaggtataatcatcgtacaaagcgatcaatattacatgctctcatccaacattatgtatactcaagatatgtttatatgctacaggagctgtctaaccagagcactctgtaagtcgcgagctttgactactattttgcagtcatctgtacattttgccttgattattaattcgctgcataaatcatctatgtccaacgatgaatattttggtagggaggagatctcttcgagaatgtggtagcaagacgcttttccattcgatatggcgctgctaatgtgttcaattgcttcagattgggttcgaattgttttagtatgagaagcagccaccggaagcaccgaagctagagatttctgattcaacaggtggcttgttattaagtcgcatttgatctccttatttgaacatggtttggtcccgatacacttgcggttgcaaatattattacactggctccctacagcaaggggaagcacgctggggaataaagtatcatcttctgtctcgtatggaagatacttttggtcaatttcacattgacatgctgacgtatctattttttcagcggtcaggcgttcagagtgctgaggaaagtagttatgaatgtcgtaatctaaagcttctagaccagtctgtctatcattggagacaagatcgagactgaaatctggcatttcactaccattaatactttcgtcaccgatggtaacggcacctgttcgatttccggggggagaatcccacgaattggttaaactgggagcgttccatgagcctatgttccacataactttctcattctcttgagtgtgcggctgtacttctatacttgtgttcacagtcatgttttcatctgaattaggcgatggcaattcctttgcagccttgctaactgctgtacttgttcctttttcgttttcccttttctgttgttcttgcagatcatcgaggaaggctaatattctttcatcatcagaattcttagctctatattttgtaatttccgacagtaaactttttaaagaacatagtaaaaagtccgtggtagtcttattctgcgcatctttctgttctagtaactctaccctctcttgcaaactcttcattttggcttctttcctatctcggaacgctcgttgagctgccctattctgggcagtcctcctactcttagcttcagagtcaatcctttttctgcctggtctgcccaccttcctcttaggtgttccatctttatttagcaacatttgcttcttcatgtcacctgctaaatatatttgctgacctttccgaaggatattgcccatttatcttaactggtcgttccattgcttatatgtcgtccttaaaagtaacaccccattcgtatgaaagtataatagtaattgattatcgattaactattgaagaaacactatttatgctgttttgaaaactaaaaacgccagtggaccgatatagaaataaacaaaatggcccttttcgtgtgtcacgtagctcccaaagttctttccgacaatcacatgccaggtattgccgtatttgacatccaattgcttctttaccgtcccagcaatgtctctttccaactggtacttgtccagagcatctttactgatggttaaaatatcctctttcagcttgtcggtctaagttttctccttgttagtaaatatatatattcaaatgtacacacacaaaacatgtatatcatggcacaattacatactatgtcagacgccttaacaatagctgcaattcatggaagaaaacctcactcttcctcgagttagtaaagaaaaattgtattgaaagtcacaaaattgtgactgagattaactgacatacgcgtactcttattttcatcgctcattttggttttaatttgctcttctttatgtcgtttcccagtttcactttttaccctggcagtagttttggaggctttccttttctgcagtttcgctagtttgtaatctccatttaaagggaaaagagaaccaggcaacaagataaagagataagggatagagacataaatagacatctatacacgtagtgagtaacaacggatactactacacatacagaaaaaatggactacaacatatttgaggcggtacatgaacaacaaagcagcacatctgacatggatctctcagaagaagataataatccattcgtcggcactcatcacctatatgcttctggaattgggactactatcggcgaagctcgcccagagaacgaaaattcgcccccttcttcatcgtctttgccatctagcccggcacattcctcttctgctggctcttccagagcatctacgtcatcttcaacctcttctcatgccgtagtggaagcagatgcggaaactgaaccttttgtttccttgtcgatgtctactactgctactattagcaaatttactccccacgatatgaatgggacacagcagatccaaatcattgatgccggcgatttcaaagatccatgggggaaacacgctatcggttacgtaattctatatgaaaacaacaagattatcagaaggtactctgaatttcattctttgaggcaatctctaactagactccttcctacgataattattccacccattccatccaagcattctcttctcaaatacatatggagtcccataaacgcagcaaatgattccaaaattatctccaccaggaagaaaatgctcaattcattcttgtctaactgtctgaacattcaagaaataagcaacgatattgtttttcaaaaatttctaaaccctgaatttaattggaaagatgttttaagttcgtcgccgataatcatactacctttgaataaccttttagctccacctttaagcccaacaaaaccaagcccccttcattctattttacctattccatccaactcgtctctgagaaactataattcgatttggcaacaacacatcacagtaaaaagtcataatgaaatttccaacctcccaacagaaattttacaaaacgaatctcaatttacacatattgaaaatttattccaaaattataagcgaataatcacccatttattaaaaaacataagatcaaataaatctcatttccactccttgtccacgtattttgctgaattaggcgcatattataatgcttttagtttggaaaatgacataaccatgcccaacagccttcgcgaatctgaaaacaattcaaacaacccaatgatggaaattattagtcatattgaaaagacaggccattcattcgatgttatatacatttcttccgagatcttaatagaaaagtacacctctattcttgaggaccccattaatgagttattgcagttcttaaatgagtcattcaaagttctaaatttcaagaaattaaagtttttgcaatttaaaatattagagaggctaattatcgaaaaagaaacgaaactttcgagtctcactgagattgaaaaccaactgcagaagattaatgaaagtttaacgcggtcgactatattgacagatgaaaattacaaagatacaaaggctgctgacctgacatttgttaaaaaggacgtaagatcgctatcgaagtcaagttcaaattcaagctccagtggacaccaaaacgaaattcatataggcgcaagtaaactaaactataaaacgtctacgccaacaatgaatctcaataaattagaaatcaaacaattgactgaacaagaaagatctaaacagatcaaacagttgaaccaagatttatccaaattgaaagattgtctatcaatctgtatatcagacatgctagaaattaacaattcgtcatacaacagcttaatgcatacatataaccatattaatttgaccattggaaagatcttgaaacttttcgcagctagcttcaaagcatggatcaaagaatgtctgaagaattggaaactggcaaagttacaaatcgacgaggccctataaaaagcattaccgtcacgcatcgtgttgcaaatagcatatacatatatatatatatatatatacatataacgtatacgttagaaaaatttgaatacacacattcatttatcctattattatcattttcattcttacccgctccccgctttcatccggtggcaaaagtaagaacaaataaaagctagacctagattgaagaaactattaagtaccaaaaagcaaacagtgggcacacgcgaggaaaccacattatatttcgcaagatgtttaataatcatgaaattgacaccatattaagcactctccgcatggaggcagatccctctttgcatcctttattcgaacaatttgagaaattttatgaagagaaattgtggttccaattgtccgaatccttgactaaattttttgatgatgctaaatctacaccattgaggctcagattatatgataacttcgtttctaaattttatgataaaatcaaccaattgtcagtagtaaagtatctacttgcctctttgaaggattctaaggatttcgatgagtctttaaaatatttggatgatttgaaggctcaatttcaagaattggactctaaaaaacaaagaaataatggatcaaaagaccatggtgatggtattttgttgatagatagcgaaattgctagaacttacctgttaaagaacgacctcgttaaggcaagagatttattagatgatttggaaaagacattggataaaaaggattccattccattaaggataacaaacagcttctattctacaaattcccagtattttaaatttaaaaatgatttcaattctttctactacacaagtctattatacctttctaccttagaaccatctacaagcattactttagccgaacgtcaacaattggcctatgatttgagtatctcagcattgttaggtgacaaaatctataattttggcgaactattacaccatccaataatggaaactatagtcaacgattccaattacgattggcttttccaattattaaatgctctaaccgttggtgattttgataaattcgactcattgataaaagttcaaatatcaaagattcctatattggctcaacatgaatcatttttacgacaaaaaatttgcctaatgacattaattgaaacagtttttgtcaaaaatattaggatgctttcatttgaagatatttcaaaggctacacacctaccaaaggataatgtcgaacacctggtcatgagagccataagtttgggtctattaaagggttctattgaccaagtaaatgaactcgttaccatctcctgggtccaaccaagaatcataagtggtgaccaaattacaaagatgaaggacagactggttgaatggaacgatcaagtagaaaaactgggcaaaaaaatggaagctcgtggccaatccatctgggtttaggccattggcagttatatataaaacacacacgcacacatatatataaatgcagaaataaaatcaactatcaacaaatattgtcaaaaatatacttcgcaactttaccattcttataaacatcattatgcaaacccaaatcgtccaaatacaacttgaaacttaactgataatcctgaagacaagaaattaaacaattagtttgtcttaacgttaataactcgtcgctataagaatgcactaggtgcatatcaatactgaagcgagaaagggctttcttcacgtaaggcattactctcgagggctcttcctcgtacatttgaataccatcagggaaggcaagtcttgtaaaacaatcatactctgggtattctaccaacagttcctttaacgagtatataccatccaatagaaatactctcttcacgatctgcaaaagtcccaacatttgcaattgcgcttcactcattttttcttgaggatctttgagtgcagctaatatctgccaaataaaggtagctccaacggaatgtcccaccatattaatgttcgttaatcccttttctttaacaagccttgttatatttgacacagcatcatataagtttcttggatttgtgatctctggtgataacctgtattctatagagtattgacaaaccgttgactcagtatccattgatttgatggtattggctaattgattaaaatcattgggcgtattctcaggatcgttccatgcacctccatgaatgtatatgacagcctctctagtgttttgtgagatttcttggaatgtcaatgtcttgttgaatagtgttatatctggtgaaatggctcttacggtatttgacatattcacgacagcctctgagcttttccttgctttgattttttagcttgaatggattgcaacttgttgtaatcttacaatcgttaaaaattttaccatgccgtgcgtgctttatagaatattgaacaatattcttttaggtatagattgattagtttacatactttctttcttaatatctacaatttttatatgagaagagtaacattagaaaacaagtgcagagcatattctgtgcatctattccttaaccttaggtttggaccattcaacacgtaaaattaaattcatataacccctaccatccaagaaacgtaaagcttgttcggcaacttcttcgctcgaaaaggtaacaaaggcgagacctcttgatttacctgtttctttgtttctaacgacagaaactcttggaatgggtgcgaatgggaacaataactcttctctcaaactattttcatcggcattttcattaacttgcataatcttcaaagtacacatatcatcacgttctctagagtctctgtaagcatcggatgaaggatctcttgcaccagcacgacgagaaggtggaacatactgccctgggatggaaccagctccgccaacttggcctgccttctcttcactggcggcctcgacaccgccttcattagtggctgggtcttctaatgctgaaagttcacttaaaattgtcttgaatggacagttcatggtcatatggtcgttaccacataatctacattgtagaccggtctttgtgagacttgccttttctttttgtattctttcttcttcagcttgtttccagttcctactcaatcttaattctacttcttcacccaatcttgctgtaacagcacttggacctgctggagaccctttttcagagccatatttatgccagttttttctttctgcaacagatttatggactttttccaatactttaacctcttttactttctgagtaatcttatacttgacaccgtcttcaatcttgtatgtaatgatagatctagatccatctgcattctctatgatctcctctggtgcaacttcactcattattcctggtggtctttggtcttttgatcctttcaatacagcgagtaactagggcttctcttccctctcttttgccatcgtgataatttttcactttccacactcagtgaaagaaaaaaattttaacttcgttacaagcgatgagtatagatcggcaagaaactttgaagcagtatatttacaggattaaattatatatctacagttccttcacctcccaatttggtgaaacagtcttcccctcgattccaggtccaatgaccgtactcaccccttctttgtttagtagatatttttcggcgactctatgaacgtccaggagagatacgtctaagagttgttcccttcttgcttgtttcatatcgtctgtaacaccgctcatgaaatacgtcacgccttctcctttgggacttttaggtgcgtctacttgttgaaatattgtcaatttagcttcatcaaggtctgtgacgccccacttggcatcgttcagtatataacgcccgctattcttgaaggtttctaaactcttcaaaggctgaggatccctataggaatagaaactgaaaatacccgctaaggcgctataagaagcaccaccaccataagcaccacccttttctctgacttctctgtgcaaatgtttgaatgttagcatatttgacataacttgaagtgcagagccatccttatgtgtatacggcacacccaataaagcttgggatgtgtaatggacctggaaaggaaattttatcaaagtatgtttacatttggatccaataagaggataatctgaagtctttggtccattgggcaagcagctgccatgaggtaatctctccatgaattttgaaatttggctttctactgttttcgcttgaacatcagagtctgaggtgataaaaaaattcatgttattggtatcaacaatgtacttttgcaattcagttagcttgtcgacaacttctctttggaaagtttcttcattgtctaacaagctgtgcaatctatttataaattgtagttgctcaataccattgagggtctcatttatagctccacttgatctataatgtgcggcagaatagccccttgcaaatgcatgaccggcatctgctacagaagatgtgtttgaagatgctaataagcggataagaactttcaatttatcgctgtttttatggaaatcagtttctagtaagatcttagaccagaattcaaaaatgtggtcggtcttcgaatttaaagaccatccgtcaaacccgaaaatcaggcgaggctctgtggtgttagggtcagatgtaacctctacatgtgttgatataccacccgtatgtaattttatctgatcttctatttcactgaaggattctgttgttgtccctaggttagttaacgattcagcaaataaaggtaagtatgggaagagttcaaagggtattatgtcatttagtaaacgtttacctctgacatatgtgataccattggtatcagtaatcctagacattgtattattcttctgttcgattgaatatttatcaccagctcttgggatgtcttttatttgtaaggtaggtaaacaggataaatcttctttttcattttgtttctcctgtaacagtataccacgtttaaagatgtttttcttgtcttgttcatccaaggcagtaattttttctctcagtcttgtttgttcttcatcatccaaagatttagagaactcttcagatccctgaatggaaaacgtgaaacaaggtttatgaacgatatatttacggattaaatcttggaataaagtatcacctttcgtttctaagtcacctctaaatctttgcaaaacgtcctcaaacaacaagctctcaaaaggatcgattttgtttgtccaaccaggtagtatagaatagagtaattgaagtccaaagtcagccttttgatccttcttagataattccaattgttcaattatggcatcgatacgcttgcggtcaaaaggatgttctgtttccaacaggttttgaaaaatattatttacagtgtctttaaatatttcaatatcactcacgccctgtataccaacagttagcaaatttactgctgtagttggttcaacacctgaatttacggagaactccaaaccaattcctgattctattaatttttgatacattacagaagaatggccatccattaataaattccccagtacttttaacaaaaaggtatcatatgtgtcctgtggcgctccacaaatccacgtcattgaggcttttgtctgcttctccggtggaagcatagtatctatttgacccagtaacttgacatctatgtctttttttaaatcaataggcattaacaacttatcctttcgagctctcttcccgtaaccactgaactgctcatttaattgctttaacgtatccaccaatggcaagttaccgtacgtgaaagtttttgcattggagggatggtaatttttgtgatggaaatccaagagatcgccgtatctcaagtctgtaattttcataggatctccgccggagttattcagggaaggataaatagactgttgaaatttactccagaaatagtaattggcatttgatatttgacctttcatttcgttatagacaacacctttgaaaacaatgttactctccgggtctgtgatgtttttatgctccaacctccaaccctcctgatcaaaatcttcttgtttaagtagcggattcaaggtggagtctaaataaacacctcttaaattagcgaaatcttgagggttcgtagtggaaaagggaaaaaatgtataatctggacctgtcatagcgttcatgaaattagctagagatttatttagcattttgaaaaaagggtccctaactggatatttaacagacccacacaacgttgtatgctctagaatatgagggaccccagtggaatctggagggttggttttaaaagcaatgctgaacacattattcttgtcgtctctatcaatatgcaaatgctcggctcctgtctgggagtgcaccaaatctaccgcagtgagtctcagctccggaaccggtagaattcttctcacttcataaccatggaatatacctccaactggatattttctaacggcctgtgcttgggcatacgaggacgcaaatcgctgaaaccgcaacatatataccgcagtatattttatagtaactttattcttttgagtagccttctaattggtggcttattgattacaattgcttgttatcatatctgtcaatgcttgttcaacaattcaatgatttactactacctttatcatagagcccctccgtatatttatcactgtaaacgaagggcaaaattttttacattcttttttttcgccacccaaagggatttaaaaaggacatgagaaaaataatttcctctcttctaaatatatatacttttgaaggaatcaaaattaagcaattacgctaaaaccataaggataatgtctgaagctcaagaaactcacgtagagcaactaccagaatctgttgtcgatgccccagtcgaagaacagcaccaagaaccaccacaggctccagatgctccacaagaaccacaagttccacaggaatctgctccacaggaatctgctccacaagaaccaccagctccacaagaacaaaatgacgttcctccaccatctaatgctccaatttatgaaggcgaagaatcccacagtgtccaagactaccaagaggcccaccagcaccaccaaccacctgaaccccaaccatattatcctcctcctcctccaggtgaacacatgcacggtcgcccaccaatgcaccaccgtcaagaaggagaactctcgaacaccagattgtttgttagacctttcccattggacgttcaagaatccgagttgaatgaaatctttggtccatttggaccaatgaaggaagtcaagatcttgaacggcttcgcgtttgttgaatttgaagaagcagaatccgctgccaaagccattgaagaagttcacggtaagagttttgctaaccaacctttggaagttgtttactctaaattgcctgccaagagataccgtatcaccatgaaaaacttaccagaaggttgttcatggcaagatcttaaagatttagccagggaaaatagtttagaaactactttttctagcgtcaataccagagattttgatggtaccggtgctctagaattccctagtgaagaaatcttggtcgaagctttggagagattaaacaatattgaattcagaggttctgtcattactgttgaaagagatgacaatcctccaccaatcagaagatcaaatagaggtggcttcagaggtcgcggcggcttcagaggcggcttcagaggtggcttcagaggcggtttctccagaggcggcttcggtggccccagaggtggatttggtggtccaagaggtggttacggtggctattccagaggtggctacggtggctactccagaggcggatatggtggctccagaggtggttacgatagtcctagaggtggttacgatagtccaagaggtggttattccagaggtggctatggtggtccaagaaatgattacggtcctccaagaggtagctacggtggttcaagaggtggttatgatggtccaagaggcgattatggtcctccaagagatgcatacagaaccagagatgctccacgtgaaagatcaccaaccaggtaagccatttatatagttgagaaaaaaaaaggagaaattaacaaaagatatgaattgttttaaaacttaaatatgagactgagaacaaatgaaaaaggaaaacatcgtattaaatgttgaaaaagttttttttttgaagaacttcctccccattccctcccctcccttttattaagtatagtttttgtttattaataagtttagtgttagaagatcccaaagtatatgattgaaaacagaattgtttattgcgagtcccgacttcactccagtagatagaataatcccatgataacatttaacatcctttttacaacggaatttcatttccaaattgatgagtcgttaaaacttctgtattggattttaattagaccttctttcgtgtaatactactactactacctctagattcttatgtgtctttcaattttttttatttccctgcaccaaactatcttttattgaatggaatgtgctgcaaaattaacaaaaataagttttacttaaagtttctaacgagaatctcctcttcaacatacgggcaggataatataattgactatactgataatgaaccccgttttttgttatcttgtgagataactcagtggaaacttgatctagcagtagaccagtttcccctcccccaattaatactagaaagttgagaaactacagaaatcttgtaatttaaccatttttttgtcccaagccgatctattttggatatcttattgtcatttttcaagtgaaaaaaggtctccctttctatacgagagttctcatatggaatgagagaataagcggtaagatatcgaacattcacaagaaataaagtaccagttaagaggtgcaattgaatatatacaatatcctatcatcttagtcctttgagtatgcaaaaagctacaaatatagttgttagtttgggtcaggctaatttcaaagaatttgaactcctataaagttaagttgaagaaactaataagtactattatggcctgttaaatctgtgttacgtattaaatgatgtgtaatccagaagttataaataatgaaagatgtccttacgtggagcttaataacagagatacaaagtttaaaagggaactcgtgtactaattgaagtgtgtacgtgtgcattaatattaataagggataaataacgataaaagagccgctctttgataaggattacacgccagaataatgtccaatgcaaatctaagaaaatgggttggtttttgctttgttgccatttatctctttttaggtgttccactgtggtacaagctaactacagtttatagagcatcactaccaataaattacattgagtcacttcaaaataacaaattccaagatattcatctcgtaataccggtgtatgttaagtcagatacttacagatttcctgacgttcatgacgctatccaagtacaagttaaccatttattgaattctcaggagcaacgggtcccttggtctttacaagttcttccatataatgagactattgagcagatggaaagtgaaggcaaccagtttcatgtcgttactttgaagttagacgaatttattggttactcatcagcttacgacaccaaagaaacactagtatattacgacgatgctgccgttttaagtaatgatctaccgttttttgttgctcaaacattggtagagcacactttccaattggaatggacgcatttgaataaaacgtgtgaaggcgtttctacaaacaacgatgtcgcaatatcttatgatccaaacattcatttaagtgtaactttattgtcaggtgatgggaatcctgttgcatgggaaattgagcctacattaactgactacttttcaccttttaggaagttcttatcaccactggtaaattttacagtagattcatccattgtttatcataatgatttgaatttgcattcattaaatggatcatgtacaagcgttacgtggtttgatctctctcatactattgatctttctgaactttcttcaatggcctattacccagaagattctgcactgaatttagccatagtctttcctagtgcttcttcaagtcccgatggtctggcgttcattaatggcactcggatttcagacgaaataaccacattagattggaatagttatctagttcctcaatggggggttataataataaataaaatgccgttgaagccaaattcagtcattagcgaagattatttagaacctatgatgtaccgttttgcgacagatatttttcaactattgggattaacggagggctcgcaagatttgttatcaccttatattaccatagattcattcaaaaggttgacaattttacagaatctagataaagctacggaaacattatggtcgttagtgaaattaactcaacaatttcagggcatgtctatcccacgcgaagtatcggataatgttatcgaagctttagacttaaggctacagattattgatttattaaatgatcctggaaagggtggagatatcgtctggaacaatgccctgcatctaagtaatgaattggttaaactatgcgaaaaggcatttttcaatggagaaatggttcaacaaaatttcttcccacaagagcacatgatagctgtgtatttacctttattaggcccaatatcggcagtcatgttctttggtttctacaacgtgatgaaggaaaagaatcaaaagagtaaaaagaatggaaccgagagagaagttgctaaagaaaaattagagttgaaagaggctcaaaaattacatgctattgatggtgaagatgaattatgagttgataactaaactacaattaccaatattttgaatgcatgtagtgtaagtacaggtatatctatatattatgtatatgtaagagtaccatataaacggtaagcatattaagatcaaattagttgaggctgtaaataaaaatcaccactgagccttcataaggatataatgagtttgcataacctttaattcctctaattcgtccaagaactgtaatgatctgagcctttttctttcagattcgggaatctgtgcattgaaaatttcccacatgtcattgacaataacgttgggagccgcagaccatctcgaagcgtatttctctttagaattatacgtcatcaacgtgggcatttccaaattccttgattctttcaagttggactgcataatggcgccaaatcggtcattcggttgagaaccaccaattggatcgtaggatatccatagtccatgtgaaaacttcgacatgattgtatttattagtaattgagactcattattatgcatgtagcacaaaagacactcagatattacgatagtgggtatttcgcgcttagtgcatacgtctaacaaacgggttgtttcagtgatatcgttcaaatcacaagcagcaagtttatatcttccttgatcaatcaaaaagggtgattttgctgtatcttcctttgacaaaccgagggagatacgcaaaatctcactttcacgcaaaatactattcttcaattctactgattcgttgtagtcaatgtccacataagctaaatgagggaacatttgtaacaggggcagcattcgtaaatcggaaccgcaacctaaatttaccacttgaaccttctcatttgcaaccaaaaattccaatatggccgcgtctatccccacagtacgcaagtatgtcccatagttcattaccgggaaggaagaccgcattgctttgtctacttttccaaaagctcgcctactaaatttcttgagagtaatcaagtagctgcgatgccattctgtatactttttggataggtccaccgacaatctttgcaggccgcttgaaggaagatatccgactgatatagcagctaatttgcacgacaacgcatcatagtcagtctgctgtatgattctctccatggcgacttgtttgtactctttatcatctagtttatgcggagtcacaaggaccctgacccatcttctttttcccctatctttccaactccagatttttcagcctttgaacccaggcgcaaggcgcaattgcccagaactcaatccccttgcttgaccatctgatgaacagataagtacctcttatctgtgcgttctgctcagaagtttcgctgcagttttcattgattgataacatagtgtgctgctgacggaatcgccttaaaatgcctgtacgaagtaaaatatggcagccgctgcactaaaccttgtagtgctcgctcttactttattgcgattcccacaatccaaaatttgcagtcgccgctacgatggtgtctgacaacttcttccacataccaatgtacgtcttgccttcacaccttactgcttcttatggcatcccatattggatcccccacgtcgccgcgacaggccttggacgccagccgttgcgttgcacttgccaaagtaactcacttgccagggtctcagcgatgcacagaagaaggcggtcccttcttggaagagagaaattgtttacataactatatagtatctcacagatacaagcatacggtagccataatatacttcgcaaaccgtacctttttgcgtaagaaatacacatatagtaggttttgtcgcctcctcttccccctttgtctcagcatagcattaacataggtgcctcagagtgacaaagagagaaatagttaactagaatacggtgcaaattcagagaaaaaatatcagattctattctatttaccccccctataactgcagaatcgtacatttgatcagcaagtaccatgggtaattccggttcgaaacaacataccaagcacaatagcaagaaggatgaccacgacggtgacaggaaaaagacactagatctcccaccactgacaaaatcggatactacacattcgctgaaatcgtcaaggtcgctgaggtcgctgcggtcgaaacgctcagaggcgtcgttggcatctaatgttcaagctcaaacgcaacccctctcccgcagatcgtccactctgggaaacggcaatcgcaaccataggcgatcaaacaacgccccaatcactcctcctaataaccactacctaacctcacatcccagttcgtcaagaagactctcttcctcttcgagaaggtcgagcatggggaataataacaattcagaattgcccccgtcaatgatccagatggagcccaaatcacccatcttgaaaaatagtacaagcatgcattccactagctctttcaactcttacgaaaatgcgttgactgatgatgacgacgataggggggatgatggcggcgagagcccctcaatggccaaagttactcgcatcaacactagttcttccgcagatagaggctccaagcgtactcctttaagacgtcataattcattacaaccggaaaaaggtgtaacaggattttcctcgacttcatcgaaattacgcagaagatcagacaatactctgccagcaagttatcctttaaatgcagaagcaggagggaatggcagcgactatttctcaaacagatcaaactcgcatgcatcatccaggaagtcgtcatttggctccactgggaatacagcttatagcacaccactgcattcacctgcgttaagaaaaatgagctcgagggacaacgacgatagcggagacaacgtcaacggtagaggcacctcacctatccctaatctaaacatagacaagccttcgccgtcagcgtcgtcagcgtcaaaaagagaatatttaagtgcatatccaacactagctcacagagattcatcatcttcacttagtccgcggggcaaaggacaacggtcttcatcgtcttccagttccagtcaaagaatatatgtttccccaccatctcccacaggtgatttcgtacacgggagttgtgcagacggtgataatggatctaggactaatactatggtcgaaatgaaaaggaaaaaaccagttcgtccagtggacatagatgaaattatccagagattactagatgccggctatgccgcaaagaggaccaagaatgtttgcttaaagaattccgagattattcaaatttgccataaggctcgtgaattattccttgcccaacctgctctcttagaattatctccctcggtaaaaatagtgggtgatgttcacggccaatatgcagatcttttgagactttttaccaaatgcggtttcccccccatggcaaattacttatttttaggcgattacgtagatcgcggtaagcagtccctggagaccattttactattactatgctataagattaaatatcctgaaaatttcttcctcttaagaggcaatcatgaatgtgccaatgttacaagagtctacgggttttatgatgaatgtaaacgacgttgtaatatcaagatttggaaaacctttgttgacacgttcaacacgctaccgttagcagccatcgtcacaggaaaaatattttgtgttcatggtggactatcacctgttctaaattccatggacgaaattaggcacgttagtaggcccaccgatgtacccgacttcggcttaattaatgaccttttatggtcggatcctacagattcatcgaatgaatgggaggataatgagcgtggagttagtttttgttacaataaagtggctattaataaatttttaaacaaattcggattcgatttagtgtgtagagcacatatggtggtggaagatggttatgaattctttaatgacagaagcttagttacagtgttttcggctcccaactattgtggtgaattcgataactggggtgctgtcatgaccgttagtgaaggcctactctgttcttttgagttgttggacccactggacagtaccgctttgaaacaagtgatgaaaaaaggcaggcaagaacgtaaattagccaatcgctgaaaaactagatattaatgttgcagttaataagctcattgaaaactttctttggttgttcctcttccttctttttttcgccgataaagttgtcgttatagtttcacttatatcttacgagaatctaaataagtaaatattaatattattcaatttctcatttcctttcctctgggttttttgagagtacgagttttattgctcgctttttgtattttcactttgccggctttttcactattccctattgtcttaataaagttcctgcttgggcccagtaaacttttaaaatttatgtgctgaaagaaagttgaaacaatcacaagaggagagcagatttgccaaaaaaagaatctgagctgtttgttcctgtctaatactaaaagatataaataaacaatatgtatacaaaagagtactactggttttcacaatatatgataataacaagcactttggtgctcaccataatatggtccatcttaccatcatcgctgggtgaggctgcaccaaagcagtttatcaacacgctattggacatcttcccacaaagaagatggattattaccttggagagcataatgctgatgggcatgctatgcacatacatcggccttctgatgtacaatgaagatacattaacaccgccgctagattctctatctacagtaacggatgccggtggtcaacttgtaatagaggacgacccggacgtattcgttaagaaatgggcctttaaagaaacaagtggtatttacgatctgtctctgatggatgcctgccaacttctctacctatatgataacgaccataccagcacatagcttttctcagcacctgtccagagacataacatcacaatcacatcgccccagtaaatgcatacgcaagataagatacaaactggctacgggaacactacgccaacgtgattggcaattgtgctctaatagttactctattattgctgttaattgacaatgtttagtcacgtgcaacacaattcaagtcacgtggaaaggccttcacatggtgatccatcttctacatcttcatcggtcctgcataaagtcataatatggggctactggaatgtatgcacttaacagtactattatatggtgaggctgtaatgcttaccgttttgtggctattctcgtattctgtaggcccccccatacacatttttcggtaactgcggcatatagatgaaagttgaaatgaatattcaaaagaatatatataataatgcaggagatcaaggaagaattagatatgtataagagtgatggtagaggcaaaaaataaaaagtaagcaggagaatgaatcgtgttggtatagacgtagatcatatgataggggtcctgcttctggccgtagtggtggtgttttgggttggcgcttcgtgtttgactaatgaattgctcgagacaaacgcgtacaataaacctttcttccttacttatctaaacatatcatcgtttgctctttatttgacgccagatctatggaggataatccaatcaagaaggaagagcttgcaggaacggacagaacgaacattacctattcacacacaagaatctttttcagagttcctacctttactatcttcaactccttctacttcttcaaatttgtcttcgatagcggacacgaaagtgaaggatacaatgaggttgagtctgctattttgcgtcttgtggttcgtggcaaatttggcggctaacgctgctttgtcgtataccacagtggcttcgtcaacaattctttcatcgacatcctcattttttaccttatttcttgccactagtctaggaatagaaactttttcgacaaaaaaactgctggggttatttgtgtctttgtttggaattatcttaattgtgatgcaatcctcgaagcaacaggattctgtgagtgcttcctcctttttggtaggtaacactttagcactgctggggtcattgggttacagtgtctatacaacccttttgaaatacgaaatatcatccaaaggtctcagactagacattcagatgtttcttggttatgttggtatcttcacgtttctgttgttttggccaattttaataatcctggatataacacatatggaaacttttgaactaccaagtaacttccacatttcttttcttgtcatgttaaattgtatcattatctttgttagtgactatttttggtgtaaagccctcattttgacatcacccttggtggttaccgttgccttaacttttactatcccgttagccatgttcgctgattttgtatggcgagaggcattttttacgccttggtatatcattggtgttattttcatttttgtttcattctttctagttaaccatcggggagaatctgctgttgaaaaggactgtgctgcggttgaaaaaggacctatcttggatgcctaacgtgattatttcttctttttatgcaatttttcacataatataattatatgtctcccatttttatatattcaaaagttaatgtctataaatgccctatctgacttattgtcttatttttttgcatggtatgtatatcttagaagcttttgaaaggaaaagtaaaacaaataaaaacggttcaagaaaatgatgtgaacctgatagaataaagttgagggagaaaacatataatttactgtgtaacaagaaggttattaaacatttctattaggtgcttcttctttgccgcatgacaactttattacagctcttgtcaaattattataaggctaaattagattcagaacgaatatacaatgaatatgttcagtcgcagtatgagtttgcatctttagacaagttgaacaacaataaaggtgacccaaagaaagtagttgatgagacattatttttgcagaggcaaattgcccagctgaataaacagttacaactttcatttcaagagaatgaaaaactattaagcgtacagaagaatcaaaaagctctttatcaaagtaagttatccagcaaggatgcattcattgatgatttgaaactcaaactgaaagtcgagcagatatctgtagacaaacataataaggaacggacaccttcaacaggccgtgatgaacaacagcgtaattcaaaagcggcacatacatcaaagcccacaattcatcttctttcgccaattgtaaatcgtgataagcctaataatcaaacgaacgacaggggtggcaacgatcctgactcgcctacatcacaaagaagatcaagaggactgagatctttattgagttcaggtaaaaatacaatatttgattcaatatccaaaaatctcgacgatgagataaatgaaaatgcgcatatcagaaatgataccacatcttccaagatagctggcaaatcgccatcaagattatctgcgctgcaaaaatctccagaactgcgtaaagaaaggaacaatatgatattaaaggaacacatactgcgttcaaaagatgaccaaaatatcacgtcatctagaaaactggataatatcgagctatctagtattggtgactctactgcaatgacatcaaggagttctaccgttaatgcaaatgacatcttgggaaatgaagagaacgacgggattacaaagctgaaaagagttaacaagttaaccagctctccagttaaaagggattgcagtacaaacaagaaaagaaaactcacaaagcagcgaattgccacgttacccaactcagatgaagaattgagtaataatttaaatgttgacgagtttgtatgagtaacagctatctacgtccctgcccttccctctctcttttacataccaacagtttagcatttttttttatataaattaccataaatactgcctcaggccgctcagcttatattttcaagtctctccatttggctgtttgaggtacccaattgttgtattcttgatacggctgtttcaactattcacataataagtgtagtctagtctcttcgatgagccttttatgcaccaagggaaattaaatgaatttctaccaaaccttattcattttgaattatgtagctctgacattttgttgttttccttgcgtgcccaatgttgccagcgtaaaagttatcgtaaacgttatcgtaaacgttatccccgttttgtaaactttattgtcttcgtaaaaaatagaaaccaacacttaaaattggtcccataaaaaattgagtcagttccttcatcgtggtacagtcagagtattctaaattaattaatttactgataatttaataacatgaagaagaaagattggatattgaagttatccaccaggcacatataacgctctaaataatatttggatgttgcactaaagtccacgatgaagaataaaaagcatcacttgatcgttcaatgagccaatcttggaaattttgacacctctattaaccagaacatccagcttgttgagaactgttgggataattcagaaatgtaactttgaaactcaaataactcaaggaacgggagtctttcaagattttggaataatttgaccactttgtttttaaacaattcgagtgaaggccatgcgcttcttgtaagctttgttaatgaatctatcttttagttaaaaacatttctttctttatccaattgaattatgccattcgatattaaatacgacaacaggaacactgaagaacgggatactcccccccccccttgtgaatgtgctacaataaacagaatatcgccacccggtcacttcttctctccaattcttactaaattagcgataaattctaccctttccataactggccgttcttctgcaagagaatttttcctacttgaataggcatacttgaatctgaaaagtagtcatagatagtgaagtctgctttattaataaaattccaggatgtactcttggagatcgaatcaagttcctagaaatcctttgagaaagaagcggtgaatacccgtaggtaggattttttcacgtaattaaaccgccttatcttatttgttgccagaaaactagaggatggaataaacatattccctaatggtgtggcatttacctgtctgtctagtttctgttagtgcattccaatgtcagctgcttcgctacattgtttccaatgaaagcttgtattttcagagtcgaaagcgtcgtcgcctctttttatggatgaaagagctctggcatgaattttctctgtagtgaaaaaatgttacggctaaagaccgtagagtgactttctttgtttttctgttcttgaatttagacacttacttcacaatagtataacaagccagaaactaagtaatgatttacgtgccattttttttagcaatatatgcataatcctgctgacgccttcgcacgcgtcaatgaaaagggacattgaaaaatcgaccggtaagtgctttcaatgagataaacataattcgaatatagggcatctcgtcgtcttaattgccttgaaaaataactgaggtcctcatcaaggaggtcaccagtaattgtgcgctttggttacattttgttgtacagtaatgggcggtcaagaaagtatatcaaataataactcagactcattcattatgtcgtcccccaacttagactctcaggaatcttcaatatcacctattgatgagaagaaaggcaccgatatgcaaaccaagtcgctttcaagctattctaaaggtacgcttctctctaagcaagtacaaaatttattagaagaagctaataaatacgatccaatatatgggtcatctttacctcgaggatttttaagagatagaaacaccaagggtaaggataatgggttggttccgctggtggagaaggttatacctcccattcacaagaaaaccaataatagaaacacaaggaagaagtcatctaccaccacgaagaaggatgtaaagaagccaaaagctgcaaaagtaaaaggaaaaaatggcaggactaaccataaacataccccaatttcaaagcaagaaatagatactgcacgagaaaaaaagccattgaaaaaaggtcgggcaaacaagaagaatgatcgcgatagtccttcatcaacatttgttgattggaatggcccgtgtctacggttacaatatccattatttgacatagagtacttaagatcacatgaaatatattctggaactcctatacaatccattagtttaagaacaaattctccacagccaacgagcttgacatcagataacgacacttcctcagtaacgacagcaaagttgcagagtattttattttcaaattatatggaagagtacaaagtcgacttcaaaaggtcaacagccatttataatccaatgagtgaaattggtaaattaattgaatacagctgcctggtctttttaccttcaccttatgctgaacaattgaaggaaactatactaccggacctaaatgcatcatttgataactctgacacgaaaggtttcgtgaatgctataaatttatacaacaaaatgattcgtgaaattcctaggcaaagaataattgaccatttagaaacaattgataaaattcctcgttcattcattcatgacttcttgcatatcgtctataccaggagtatccatccgcaggcgaataaattgaaacattacaaagcattcagcaattatgtttatggagaacttttgcccaatttcctatctgatgtatatcaacaatgccagttgaagaagggtgacactttcatggatctcggttcgggagtaggtaattgcgtagtacaagctgcgttggaatgtggatgtgcattaagcttcggatgtgaaatcatggatgatgctagcgatttaactatactgcagtacgaggaactaaagaagaggtgtaagttatatgggatgcgtttgaacaacgtggagttttcattgaagaaaagctttgtggacaataacagggtcgctgaactaattcctcagtgcgatgttatcctcgtaaataattttttatttgatgaagatttgaataaaaaagtcgaaaagatactacaaacggcaaaagttggatgtaagatcataagtttgaaaagtttaagaagcctcacttatcagatcaacttctacaatgttgagaacatcttcaatagattaaaggtgcaaaggtatgatcttaaggaggatagtgtttcatggacgcatagtggcggagagtattatatatcaacagtgatggaggatgtggacgaaagtttattcagccctgctgcaagaggtaggaggaacagaggtacgccggtgaagtataccagatgaggcactttgaacggcttttaacgatgagtatgaataactaagtagaaataacatgtacacaagtgtaacttataaaaatcaaaaaataaaaaaatagaaagggagagaataagagtaggtaataatatgaattaaaagaaggataaggcgccgtggaccaggtacctaaaaagtaaagtaccagtttatattaacaaaagaagttcaagctaaaaagtagcaatatgcgaaggaaaggaaaataattgaaggaggaggcagagaacaaatttaaatcaggagtgcaatatggaaaaaataggagcagataatttctcctcaccatgtagactatctaacactagcacaaagtcatattccagaatatgagcacccacttgtctgataaggtcgcccgcagcatatgccgttccaccggtggcgagaacatcatccacgacaaccacgttggaatcaaagggaatggcttcaacctgcatttcaaaaatttcttcatggtctaattttgtgaatgttatagaagcacactcacccggcaattttccaactctccttattggaacaaatccaactcccaatgccagtgctagggatggcccaaatagaaggcctctagcttctatacctgcaataaagtcgatcttttctttgccgaacttttcttctaaatgcgtcttgaacgtgtgtaccaacttttggaatagcgtggggttgccaataataggtaaaaaatcctcaaattgctcaccctctatgggaaagtcagtgaactgcctaaatgcagtttttatttcctttgcgtaagattcagaaatagacataatgagaggcggacaggcaatgaacaggcatatacacacgcactctctttttttaaggagcgaaaattatctgaacgattggtatgaacgggtgcaaaatttactttaacacccaaaaagtatatgcgtatatatatatatttatccttgttatttttgtaaattgagctatgcaacataagattcctgcgatgtaagaactacttgctaatcaagagaacttcaacaattttccatcgcagagacgaaaaaactggaaaaaaataaaaagaaaaaattgaaaaagaatcgcgacttccgattacataaccttatacggagtatgataccattcttgacatcatcaacacaccatcgcagacccacgtggccgcttcgtgtgccttgaaaatacagccttaaacgcaatctcattcgcgttctgtggaaattgtctcggactacacgctgggcgtgcatcaccagtgaaaatgccgtaccgccccgcttccggttttgtttttataaatccgactggagaaatagacttctgggtttacaccccggaataatactaaaaccaaaactggtaaatagggctacagatgagcaggaaaacgttgccggaaaaagtttatttatccgagagaataattgatgaagaagtagcggtatgcacagtagcggcggaagtattagcaatttttactctggtgtgcacaagagtgttcatcatttttttcacggctaggatatgccatggaatatggccatcttcgccatcagagagaccgtaccacacgtttagagcagccaggttgcgaaactcttctaagatggtttccagcaattgtgtactatcagaatgtggacagtttaaaaggttgactgcgaatttgtcccaaaccgtatcaccgtcgcattttttgaatttgatcaaagcaccactcctaatagcacagcgatgctgtgagtgtgccagtgggaacgggtgctgaaatactattccatggatgtcctggtctatatcccttatttcatagtcgtataatctggtcatatccatgcgtcctccaaacctagtgtctttgtagatcggcttgaaactagggtacaatttgtcctcatctatgaaggagattttagagttgtcatccacacacaccacagcaagatgtatattcctaccagaaagtctcctccaattcatcaattcatcatccggcagtatgccattcaatctagttaaaattagacatatttttccgaattttttagacgctaaatttagggcgatattccatatttgattacatgcgtcgtcaaattttcctctggaattcccgacgtaccacgttttcgtcatgctgccttgtccatagctatctgaaagagctgcaaaaacccactctttatctacactacgcgagtatgccaggtggatgtacgagtcataatatattatagaagatgatcctgtactgttattctgctgctgctgttgctgttgctgttgctgttgcatttgctgttgctgcatggttctgaaattcactttctccggcagcgtatgcgcaatgtgggtgaactttacagattttggcggcagcatgttatatatagaaattgctacgttgacgtactgatccactgtcaccagtacgtttctaatgaaatccataggaataactttcaaatatagttcaatgttaggcatcttggcacaaacttcgttcttgatcacctgaaaaatattcgccttgtctactaattcagtcagagttgcattatccaagggtaaaattattaatattggtggcacgtttttgatggagttcttattattagaacagtatgaaacaatctgcgcagctaacaacagtaacttgtttttatcaaatgccttcaagtacatcagtccgggcgggtcttcattagttagtttaagcaactcacaaaaccctaactcttgattaatatatgtttgagatagagttggcgcaaatgacagacaatcttctttgaaagatgaacttaataataaggatttgaagttttttattccatttggagggcgaaaattgaggaacttaataaatggctgagagtcgtgtttgactttgattagttcgtgatgtttctttacaaaaacgtacggctgcttcatgttatagaatttggagatcgtatcattgccatttaatctatcgaaagtggaaaataactgtaacattgtggttgttattaaaccttcttggcaatctttaactcccctataggcgatctttggaataccgaggtttcctaagatattataatcagtgacgacttgttctgcaattaaatctaagatgtcttgttctttttctgaaattgtaacaacgggagtaggcgtgatgaaaatgtccggtatagatgctagcggcatgtgtctcaatagaaacggtagactacttgatgattcaaaagataaattggggtccgccggtgtgaattcggggataccactcttgtcttttggtaggttagaaatttcagaatttaccatattcggcgtaaattcggacggattactggtaacattattatcttccaaggtcatctttatattggattctatgggttgaatagatgaatcaacggtcttcagtggtgactcggtctgtggtatatcattttgaggaattttccaaatagagttgaagccttccttattgctagtgatattagcatcgtttactgaattgaaattttcttgctttataatagagtcttgtagacttgggatcgaagagtaatttatgtattgaggctcatgaatattagtattagtactgatgttatcagaaggtttcatgtcgtcgcgtacgttcaatgactttagatcctcatcgctgctaccgttctcttcttcatcctcttcctcttcagagctagaaagatccgccatagaaatatcaaagtttaatgcttcctccttttgcaacggactgaaggaaaatttccctccagatttgtatttgttatcaacattgttttctattatggggttaaaattcagtggagcgaacacacttttgcgtctatcgcggggtgtttccacagggagtggcgcacctgggtccatatataatggactcgttggcaaggtcatttcatctatcggaatatccaaatatttcctctttccatttaatctttttgtagttccgctcatcgtacggatattcggtttttcagatgagggaaaaaatggaatatctttaccaagatcagtatgcatttccttgttatttttattaatgcttttattgttattattttcttcttcatcagacatttcgaacatatcctcggtaatttcgtccgatatacttttgttcgattcgtttgtagaattcgatttattgctatcgccaaataaatcctcatcctcatcctcaccaaacaattccttgtctaccatagagtcacttttatcacttggcagattttcgttctgttctcgttgttccagtgttccctctttattatgaagtgtgtctacgcttcctgtcttgctcacggaattatttaccttttcgagtgatctaccatttgcctccagttccgttttcagtgggctgttctctaagtcatttgatactgtagtttgtttcctatcattaaataattcattctcattgatgttattattaggggtatttaagaaagctggagcaaattgatcgctgggcgacagcattaatttatcaatgcctgtgaaattaggggagaaatctttcggagatatcttattagtttcttggacagaatgataagaagcgggttgagaactaattgagttgttcttataatgttgaaactgttctgtatatgctccatctgagcttaagggatttgtaccagcaatattactgctcaatacgccggaacttcctggagtcctataggcagctgtttgctttaattgtatgaaatcatcaatggcatccagagcatcttgcaaacagtgaaattctgatggatctccggaagtagaattttctatatcagctactggttgggcgaagattaaatgcagcggccatactagcttctttgcttcaagtaagggagttaaatacgaagctatagtaggtgtgtggccgttgagatgtcctaagtcaggaacaacagcaacccatttcaaattttttttattttgtaagtttataccatgagatacacttaacgtcgtcaagagaagttctgtatgttttggtggcgttatcaagtatccttgcttggaagcaggggccaaatgcatccttattccagatggtgctaaataaagcgcatgctttgaaaggaaagattcttccaaattttcctccttcattggtactaatcccatgttcttggcacataacgacactgtgagatctccgtttacaaaaaggtgtggttctagctgtacgagataatttggcactccgcttaatgatatgcaggcattcccaaattgtattagcttattgtgtgaacctaatgccaaattaatgtaaattttccttcttaaagcttttaaaaaaagagcatagtgtggcggtaagtttggctttgaataatcggcagtgaaagttccgattttatctgggctcactggtttatgttctatcgcaggaggtgtcggtaccggatcatcatttatactgaaacaccataaatcccttgaaagcagcgcaactagagtctttggatcctgcttccgtagcatgaattccatttggatagaccattgatcgttttgggctttagaaatgtactgatgatagttgatctttttgattttctccactctatagaagctggataaaacatcctcaagtctgtacgtggaagcgtcagaactcatactacctcctcagatcttgatatccagcttaaacgttcttaaaatatagttacaccttacttcaacaaagtaatttccgatttcacaccattcgtcttaaagggttgttgtaagagtgtactacaataaatactacactacttgatccggcactacccggtccctccacctgaaaaaatgtttcaattcttcgctttgttaagcgcgaatatatcgatgctattttctaaggattgtttattcagtatgataaaacaatgaacagcaggaaatgcggaggagaatcacttactcggctgttattcatcttcttattataaaagaattgctccattttggttcgatcccttaatgccttacaaaatcaaccgaatgaaaaattcgctcgagataaatgaaaccggaggtaccttattggttgatgagcggaagagattaagaataggtgagttatatcgctacaagttttccgtgaacaaagatgtaattaaggaacaagggctagatgtatcgcatctattcttgaggatcaagaacgaggaaagcgcgcttctgcgaccgctttatttgacggggccatattctttttacatcgatgttaggccgcataactataatgagaatcgcaagtttccagggaaggaaattattccatttgttgaaaatctaaagccggacgaaagatttaaagtaaaaatattattgaatgagaattctagagttggcgacacttctctttattcatggacaatagatataatttcgcagttggcggtaaccacaattccgaagctggaattttcgtttaggatagggactacaaggaaggtggtcaagaaatcgaatgggctctttaagagtattgaaggtgtctctttagagatgtgggatactgaaaccctttgggatttaccaccaaaatttccagaaaagcctgtacatctcgttattatgacacatggtatattttctaatatcgggtgtgatatgctatatatgaaagataaaattgaagaaatgacgtttcctatggatgagtctattaatccgaatataattgttcgaggttttatgggcaacgtcgggaaatcaggtcacggtatacattgcttgggcgttagagttggaaagtatgtgcttgagactgttgataagttgaataaaaagtacaaagtagacaggatatcattcattggccattccctaggagggccaactcaatccatggcggtgcgttacataagtattaaaagaccagatttttttgatgcagttaaaggtgttaaacccgttaattttattacgttagctagtcctttcatcggtgttattggcgacttccccttttatttgtctgttccactggatatgggcgcgcttggtttgacaggaagggacttgaatttaaaatatacaccgttaacgtccaaagatgggttgtatgcagacgatgaagtgtacccagaacattccaagtacatattagaaattcttccacaggcgccggctaaaaaagtatttgagtcttttaagaggagaacgatatatgccaatgtcatggatgatggtattgttccattacgaactgctgcacttttgtatctggattggcgaagcatacacaaagtccagaaaattaggaaaaaaaataagaactctccaacttcaagcgagtttgtgtcctccgatagcccagagagtagtggagcatcatcaccttcaaacgaaaatggtaacaacgtcggggagattcctgcagaaagtccaaacaaaaaagcgacgttgcagtggactttacctcaggccgttatccacggaagtaaaataaataaatataagagaggacaaactaatgaagccaactcagattcggataatgaacaaggagtatttcttgatggtcaaaagttcgaacctccaaaagaagccaatactgtattgtctgcattatcggtattgacagctgccataccagatcaggagtatatcaaaaacccggctgtaaggaaagatgaagtcattcatgataaactttatcacccggaagaattacctccgccgcattatgagaataggcctatcgttaagaagcttatatatcctaatgagagtgtcaacaggattcaagagcgcattgctagagaatggcaagaaacgatgacttggagaaaagtattagtgcagatccagcctgattcccataacaatatcgtagtaagaagaagatttgttaatttatacggctatgttgctgtggaacacatggttgagcaccatttcggatccaaggtttgtagcgagctggctgaagatgcaaatgagccaaaagatgagccaaaccagtcatcgcaagcggaccggtcgaatgagtataacgagggggaaatatcaaagggcgcggagaatgccacatgagtttgatgatttataatgtatacgtaaaaaaaaatatcatagatgaaataaaagtttcttaagaatatcacaatgaccacaataaagtgtggatgttgtttaaaaaaaagatagccctgtagggggctcgaacccctaaccttatgattaagagtcatacgcgctaccgattgcgccaacaaggctatttcgttggaaaaactaattaattttggaagtaataggacattaaacatgtttgttgcaatgaaactttaaaatatcatctgtttagttttattcatgttacttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatatctacatacctaatattatagccttaatcacaatggaatcccaacaattacatcaaaatccacattctctacattactagtatattatcatatgcggtttaagaaaatggtataaagattaagaaacagtcatgaaaatttagtgaagctgaaatgccagtattgataatacgatagaataatgaatgacaaagtatataaggaagatgaagtaacattattatggagaactatcgactcccttttgtgaatttctatatcctcaaggagaattgcttgtatactatgtatatataatattataacccttgacaacaatggaataattagtccttaaacgttagactggctgggacagcacgacctctgttggctaattttacttttcccacaaccgtagatcttgatttcatgactgttttcgtggtaatgtccgaatgatacatatataagttatatgctttcactttataagtattagcgtttttactcaccatccactgctttgagaagatgtggtcagcaaccacgcaatacatcacatattttggcacgggtgatgtaccgatctaatggctaagcttccttttggaagctgatagagatccagatttgcatctctatcgctattgtcgtcatcgacactgctcacttagtgctgcaggtaaattccgtttttttccaaattaatatttatgaacgttatgatgtcaagttttttcaagaagtaattatccgcgaaaaaaagaatataaaaaatacaaatgtgcatagatcctcacatagtatacaactaaaaagcaaacaaaagaacatcctcaaatgactgttataaagacagaaccaacaacagaagtgacattatattctccaccatcaaaagaatctttaagtaaagatgacgcccacagaaaaaaacaaaataataaaccaccttcgagtataaatagccgctcaggaccaaataagcataaacttgccgccaaagcaccggaaaagaaaatcaataacacagataaacaagacctctctgcctttttattaaatccttcccttattgttaaaccttctgagagcaaaaaaaaagaaaatattgtggcctataatgatacaccaggtataaaaacagaacatacagcgtttcagccgctgacaccaatttcgaaaaaaagggccctgaaagagaaagcagcatcagaaaaatgtgatagctttgatctttccagagacgagaagccttatattcagaaaaagtcaaagacgctttcttccgtcacagagattaattcctcagaatataaactctcactaaatggcgaaaatacatcatccccagctaaggaaaaatcgcaagaacccatagaaaatcctggaagttaccaaaaaacaagaaattacctttttgaaaagcccgatcctttagacacgtgccttcaggactactcgagtatgctaccgtcaaatgtagcagaagaagatcaagaatattttatcagcgtagctgattcgacattggaggagtggactaacaagggccaggaaattattgaccaacagttccagctctaccaagaaataatcaagaaacgaatagaactaagctacaaatttaagggtattatttctgtaatcaatgatagggcagatgccctagaagaacagggtcaacaactagaaggaaaaattaagaaagttaaaactttggctaatgaaattctcaatattatataaacgcttcataaagttgatcaaaggtgctatattcagtaacaaaatgcttataattaagagaatacatccctaataatgaatcatatctttcatattttagatgatattgaaattatttaactatacataaggagagtcctcaatgaaatggagtaaaacagacgacatgataataactatatcaattcatgctttttagtttctctttctgtaacgtctgtctctttgagcggaaacgttgatgacagataatggcaacttcaaacccaaagatttaaccaagtcagaggtttggttgtcaacgttcaaaacaccgttagaacgagacaagtccaaagcagagacttctgggacgtattgatcctttctttctctttcttcttcttgcaatttgaaagaaatacctctaactggacccttttggattcttttcatcaaatgagtagtgtaaccagcaatcttgtttctcaatctcttggattggatagttgcaatttcatcacaaagtctcttgttagtttggaaatccaaggtcaactttggatagtaacgttcaatcaaagccttggaggcacgtttgacggtcttggttctaactctaccctataaaaatagcaataatcaaatgagacaacttaagttagtaaatacctctcttcaagaccattggataagatagaatgtgccattcgaaagcaattggttatttggtgatcttttaaatatctactacttcattgagcgctcttctaaactaatcagtaatggagttttctaatctgctcataaataagaatgccctgctggtcccctcgttcccataacgctttcaatctctctgcaaaccttgccctcatttcatgtgttcagcgcccagtccatcatatccggcttcatcaacatctcgtggtacgtaccatttttatctgcttttttctttatctatttattcttctctaggttatacaacgcaaaataaataattaatatgtaaaatatctgtttacttgaaatttacccttaacagaggtactaacgggaggaaggactggccttgctccggtagacctcgatgcctgaaccttctccctcatctcgaaacggtacgacctctgagaaaacgatatcaatcaatgcgcgtcttccagatgaaattcttcggaatgcccataatacgaaaaactaacgatggaaaaaatactataaatgtatgggtgtaattttaaccgaatgtatggatgttacagggagctttatatatgtagaaaattccagacgttccaaacaaataagtgaaaatcaacacgattgggaaagtacatgccagagttcgatgtttaggttaatgataaaaataatttttctctaatcaccctccattttcgataaaatatcagcgtagtctgaaaatatatacattaagcaaaaagaatgtcaaacaagtttcactgtgacgtttgttcagctgattgcacgaacagagtgagggtttcatgtgctatttgtcccgaatacgacttatgcgtgccctgcttttcacaaggctcgtatacaggaaagcatcgcccttaccatgattataggataatagagaccaattcataccccattctctgtcctgattggggtgccgatgaagaattgcagttgattaaaggcgcacagactttagggctcggtaattggcaggatattgctgaccatataggcagcagaggcaaagaagaagttaaggaacattacctaaaatattatctggaaagcaaatactatccaatacctgatattacccaaaatatacatgtcccacaagatgaatttttggaacagcgaaggcatagaatcgagtccttccgggagaggccgctagagcctccaagaaagcccatggcatcggttcctagctgccatgaagtacaggggtttatgccgggcagattagaatttgaaacagaattcgaaaatgaagctgaaggtcccgtaaaggatatggtttttgaacctgatgaccagcccttagacattgaattgaagtttgccatcttggacatttacaattctagattgacaaccagagcagaaaagaaaaggctattatttgaaaaccatttaatggattacagaaagttgcaagctattgacaaaaagaggagcaaagaagccaaagaattgtataaccgcataaaaccttttgctcgtgttatgactgcacaggattttgaggaatttagcaaggatatattagaagaattgcattgcagggcaagaatacagcaattacaagaatggagaagcaatgggttaaccacgttagaagcaggtcttaagtatgaacgagataagcaagctagaattagcagtttcgagaaatttggcgcttctacggcggcgtcactcagtgagggcaatagccgttataggtcgaattctgcacataggtcgaacgcagaatacagccaaaactacagcgaaaatggcggtagaaagaaaaatatgaccattagcgatatacagcatgcacctgactatgcactgttgtccaacgacgagcagcaactttgtattcaactgaaaattttacctaaaccgtatctcgttctaaaagaggtaatgttcagagaactgttgaagactgggggtaatctaagcaaaagcgcatgtagggaactacttaatatagaccccataaaagcgaatagaatatacgattttttccagagccagaattggatgtaacaaaaaaaaaattgaaaagtaactacaattgtcactagttattattggccaagtcataaagggaccttgtctcgattttatataccgtatatcggttctttccaatttttttttttttttttttttttttttttttttttggttgtaatattaaaagaataaacatttatctgatatgtaattgcatttataaaatgtacagtaccgcatttaaagtttgctgataattaaatctagaattttatacctaggatcatcttctgcattcatctttttcaaataattgtcttgtaaatatgaacgatactcatttttcaatgacttcaccgatgcgctatccaatttcgatatatatgcaaaatacttcttaacagacaattgtaattgatcaatatcgagtttctcaactggcatatatctgatatttagagtgatgtcaatcattactgttttcaaatacaattctggtagatccttacggagcgaaaggtcatacatgtcatttttccaaaactgcaacacgtgattgataagatagtctctttccaagtctaaaaattcatcaaatagtttaatataccttagtgactcactgaataggtaattcaaggtctccttatttagttcaatattcattttggaatctgagatggcatagtaacccttatgcttattaatataatgcttgcccaaagtcttcatacacacatcgaaaatagttaatgcaatgtcaccgcgtaatgctgggttggtctctgcattacctagtacgctgatgtctgcctctggtaactcgtttaatttatctttcattgaatcaccagtggatggaacttgtaaatgagatttttcttcgtcgggggcttggttattcttttgttcattttgcatgtcgagctcctgctctctttcattgattaaacccatcacttttcttctgttaatcaacttagtgatgaaattcagctcgaattttacatattcataccatagcttaggcacatcagggttaaacctcaacccattctgaaaaatatttctacaactcttgaagttagcatgaacttcatattcgtatttcgcacaactaatccaaatgtccacattcgttgggtgcaactttagaagctgattataaatgttgtgaatttttttgtatgatgtttggttacctctcgctttcatgtagttcaaatacattgcccaaaactttaaatcttgtggaaatttgttcgttcctctttgataaataaaacctattctttgttgaatagaccaatcagatagactgttcgtctttttaacctgtaagattctcttacaccgcttggcacgtaatttattgacgttactttcatagttaatgtattttatatagtcatttatgctagaccctctggaatttaatctatgctcaaaatcagttcttttcttcataattaatgaaacttcatttttagtgaatagtcctttctccaccaagtcatccatttcaggaatacattgttccaaatagtatcttgtcttcgacattattagaaatcggtgatgtgtgtatctctggtcaatttcacaatgttatgcccttagatatgtgtttattcacgttcactgtgtgttcctgatatttagctcatcgcccagatctttctaaaaaattttcaagagaatacccggatgaaaaagcgtgttcggattcccatcacttaatgaagcttatatctgacagcgcaggaaaagcacaaaatagaacctagccacttcgcgtaaaagctcataatgttaacgatatagtaatattttgacgcatcgaactttatcacccgcagcataaagtactgatactacaagtttttttcgttattcttaccggtattgcgctaaagcagttttgcacctgaaaacaagtaaaaataggacttgaaaaaattaaatagcatacatgtataatataatcttgatcacggcaagtgtttcaatagagatgtggttataatttgtcacttgtgcagtcaataccttaaattaacttttacaaagtattttttttaaacggcccatgagcataaattgagaacgatattattaattctagtatattttaggaacagcaggccattatatccaaaacttttttaaaatagcatccacatcacttactggcgtacagtttcgtgtctggcaacaaaaaagtacatttaatttcaatgattaaaaagacattaaacatccgtacattacgcacccatgcatgctatctgaaaatattctacatgctgcttttagaaatttgaagcggcatatggtgtttccttgcggagacgcgcgctcaggggaactgcgattccgaaagatgcctttcccagtcccatatgcccatcccaagatcatgcccgggagagcaaatgtcgccccagccaggtcggacacatctgtcattcgaccactaagtattgtcaaagctagggttaattgaagatagctctacatgttattagtagagtttttaaacgttgagatactagtgaacgtatacacaagagcggataaaagatgtctttagttgtccaagaacaaggttccttccaacacattttacggtatgtttattattactagtgagctatgacaaaatcggctaaaaacttaaaaatatgacagacaagaaaggaaattcattcacctctttaatcgtggcgattattcgctaacgacgtgattaaatataataatgatgttcccgggctggactaagaacgtaataataaggctgatgaacaaatttatggtttatgcatcaaaaaggaacatgaatttggcataagcgcacataattacggaacattgcaatagcggtcggaggtaaagtaccgggaatgctttacaatgaatcagctattggcggatattgaccaaccaacactaaaattttatatcctgctccgatttttgtcttggccgtgaaatccattatgcacattttttactaacgtttatcaataagttcggtttcccgtctaaatttttttacgcagtttgttgaacactaacgttgacggtaacattaagatcgtttacgctttgaccactatcaagggtgttggtcgtcgttactccaacttggtctgtaagaaggctgatgttgatttacacaagagagctggtgaattgacccaagaagaattggaaagaattgttcaaattatgcaaaacccaactcactacaaaatcccagcttggttcttgaaccgtcaaaatgacatcactgatggtaaggactaccacactttggctaacaacgtcgaatccaaattgagagatgacttggaaagattaaagaaaatcagagctcatcgtggtatcagacacttctggggtttgcgtgttagaggtcaacacaccaagaccactggtagaagaagagcttaaactgataagattattcaagcttaatcttttttgtacgagtacatatatttccatagcacttcctaattgacttttttttaaaataaataaagaaaagaaaattaattttgtgaccataatttcaacttgccttttttttgtacagggtttcagggataaatggacccttgaaagaatataatattacatctctatatagatttatgaaacaggccgctttaaatctaaaaaaaaacgttggtgtagtctcagtcattactttgtgtagtttttgttaatattgatagcatcagtgctcaagaaaataaacactgagaaagattagtttttgaaagaattgagatcgacctccccaaggggttttctttcgtatgcattgaactttaggcggttttccttgcctttaggacttttgataatctcgctatgaccggtatttgataatgttctcttaacaagcacagatttcctgtggaacttgagctgtccgccgggcttgcaaggcgttatgtggtggtcttcgaagatcgaggacgtattggcaggtgaagttttcagcaactctgcagtaatagcctccttcgtactcgttggcgtagaggtaatttccaacgcagcgtctgagtaagatatcatagacatcgaatcattagagtgaactttgcaatggctggtgttgccactgttcttgtgctttttagcagcctgccttttgttctgaaaccatatttgaaccgatttttcggacatattacattgctcggataactctatccttttagccttattgggcgtgggacattcgtcaaatgctgtttgcaatatcccaagctcatatgatgaagttcttcttcttttccgacgagctaaccgagcattgtctatcttaggctccttctttggaaaagtttcctgtgagtgtgtaataaaggcaaatgaccttttcttttcttttcttgtggttggtgtgagaacagcctttgcagcagatagaggagtaagaatattaacttttttataagagtgcatactctgaggtggctgctctttagaacagactctgaccgttggcgtgaatggtgaatgagagctcagcttcttgggcttggataaaggcgtcatggaagtggttacacgttgtgataagaaatccacagcctgtggacttttcctttttggcctttcctcatcgcaaggacttttataaatatttaccactggtctcacaatgtgcgcagatgcagctaatggtggcaacctgatgtcaccttggtcatcactagggaagtttgtatttggcaaagtatgcagttggaaaggcgaattagaagtacctgtaataatgtttggtaaagaaggaagcacggtatttctgctttccatgttatatatatacgatattttgtgttattgttatttccctacaaatgctagttacactggctggcgagggtaaagaagaagataatacgaattataatctacgttggcaagatcgggaggacgccatatatatatttataaacattcatctgtgtgatccagatcaaacaaataaacaatgagtaaacgaaaaatctggctgaaatgtctcatgctattaacccaattcagcattgatattaaaaataccgacgtatccctgcacggaaagcgcgtctgatgtttaccattccgggtttttggcgcgcgtcatgtccaaattaggacgtggtttatagccgaaagaggaaatgtgatctgcccacctgtgcggcccttctctgagcgtttcgagcaggatgcataatatgctcccttcgtacggtagaggacaaatatgaccattacccgactattgaggacatatgtcgttattagaatttagcacctttaaagttatattgcacttttaattaccaagattcatttgagagtgtaaagggttttatggtagaatacaagtcagaagaaggctaaaatcaacagatcaatattttttttggttgttgggttggagaattataaagtttttttgatctccttgtctccagctattgttttcattgagtaggggtagagctagttagctgcttttcgatggttgtagtgggtaagagtgaagtgcgcaatgtaagcatgagtaggccgaagaagaaatcattgattgccatcctgtcgacctgtgttttgtttttcctcgtgtttataattggtgctaaatttcaatatgtttccgttttctccaaattcttagatgacaggggggacaacgagtcacttcaattgctcaatgacatagaatttacaaggctaggactgacacctagggagccagtaattatcaaagacgtaaagacagggaaggagagaaaattacatggacggttccttcatattaccgatattcatcctgacccttattatgtggaaggaagctctattgatgcagtttgtcacacaggaaaaccaagcaaaaaaaaggatgtggcacccaagtttgggaaggcaatgtctggatgtgattctcccgttattttaatggaagaaactctgagatggattaaagaaaatcttagagataagattgattttgtcatttggacgggtgataatatcagacatgacaatgaccggaaacatccaagaacagaagcacaaatttttgatatgaacaatatcgttgctgataaaatgacagaattatttagtgctggcaatgaagaagatccaagagattttgatgtgtctgtcattccaagtcttggaaacaatgatgtctttccacataacatgtttgcactaggaccaactctacaaactagagaatattataggatttggaaaaattttgttccgcagcagcagcaaagaacttttgataggagtgcttcatttttgactgaagttattccagggaagcttgctgtcctgtcaattaacacgctgtacttattcaaggccaatccgttagttgacaattgtaattcaaaaaaagaaccaggttaccaacttttactttggttcggttatgtattagaagaactaaggagtaggggaatgaaagtatggttaagtggacatgtacctccaatcgcaaaaaatttcgatcagtcgtgctacgataagttcacgctatggactcacgaatacagggatataatcattggaggattatacggtcacatgaatattgaccacttcatcccaacggatggtaaaaaagctagaaaatcgttattgaaagccatggagcaatccactcgtgttcaacaaggagaagacagtaatgaagaggacgaagaaactgaattgaatagaattctggatcacgctatggcggcaaaagaagtttttttaatgggagcgaaaccatctaacaaagaagcatatatgaacaccgtccgcgacacatactatcggaaagtgtggaataagctggaaagagtggatgaaaaaaatgttgaaaatgagaagaaaaagaaagaaaagaaggacaaaaaaaagaaaaagccaatcactagaaaagagctcattgaacgctattccattgtgaacataggtggttcagtcattccaactttcaatccttcctttaggatctgggaatataacatcaccgacatagtgaatgactccaattttgcagtttcggagtataagccctgggatgaatttttcgagtcactaaataagattatggaagactctttgctagaagatgaaatggacagcagtaatatcgaggttgggatcaaccgcgagaagatgggcgaaaagaaaaacaagaagaaaaagaaaaatgacaagactatgccaattgagatgccagacaaatacgaactcggccctgcatatgtaccgcagttattcactccgacgcgtttcgtccaattctacgccgacttggaaaaaatcaatcaagaattacataattcatttgttgaatctaaggatattttcaggtatgagatagaatatacctcagacgagaaaccatactcaatggattcgttaacagtaggaagttatttggatcttgcaggcagattatacgaaaacaaacctgcatgggaaaaatacgtcgaatggtcatttgcgtcttctggatataaagatgattaagttaatatacacatagaaatgcatatcattcttcaattacagtttctttttcttttgttacactattctttcaagtcaatttcataataatacaaaaccatctttcttatcatatatagggtgatgtatttttaattatttaatagggcctagcgttatcgtgcgaagattaattattggcatttttgaaatactccttggaatctttaacgtcaggtttgatggtggcggctcctggggtccagttgcatggcaaaactgtaccatttttgtcagtccactggaaaccttcgactaatctcaaagcttcattgacgtttctgccaacagataaatcattgatagtgatatgtctaatgattcccttcgggtcgattatgaacaaacctcttaaagctataccttctttttcaatcaaaacgccatagtctctggataaggaatgattcttatcagcaagcaaaggaactttaactggacctaatccaccgtcttttctgggaaggttggtccatgccagtaaggaatattcagagtcggtggaggcaaataaaacttgggcgccctgatcttcgaatttcttggcggcatcggaaaacgcaacaatctcagttggacagacaaatgaaaaagccaatgggacaaaagctagaacaacgtacttacctttatacttttccagtgaaatttcctcgaagataccgtcgactacggcggttttcttaaatggtggggcttgtttttgaacttctgctaccatgattggttttttacgttcttgtaaggctaatatattcttgagcaaaaaacagtaatagtgttcactttggatatttcaagataaacaatgtaagtagcaaaaaacaatcgaaattacaaaatatattcttacaatcgtctgctctaaatacgttaatctaaatctcatccatagttgatccttgattactcgggtaacaaacaccttagcagatgtgtaagagaaaggagagcctcgcccgctcctaaacgacgccaattgtaaggggggatcagcccttccaacccccaatgactaaaacttgtaaactagaggggcgcatatagttaagataatcagatactggcccaatatgatattgtctagatcttgaggatgaccaaccaacagattcctggccacagtatccgtggtcattgattttggcacttggaaattcaagagatggttctagtcgtcgtagcgcttactaacaaaaaaaactagcataagcccgttgagaacttttacactatattaattgaataattggacgttttgtcgctttgcgacagcactctcctaccaggtacatacttagtaatgtctatatagggctacatcatttttctgcaaagataaaatccttcaattccttgtaggccttgtccaaatcatcattgacaataactttgtcatgggcacctgtctcagcatatgccaattcagcttgagcggcgcttaacctcttgttgatggattcttcggtctccgtacctctaccttctaatctttttttcaaatcctcgaccgatggtggagcaataaacaaaaacctggcatttaactctgggatagccttgacagatttgacaccctgcatatcaatatctaaaatacaagtcttaccagatttactgacttgtttgacggaagcgacagtactaccatagtagttaccggagaattgcgcccattcaatgaattcattgttcttaatcatagatttgaattcatctacggagacaaagttatagtccttaccgtttacttcgccagctcttggggttctagtagtggatgaaacactaaacccgaaagaatctgggtattcagcgaacaatttcttcaacagtgtagatttacctgtaccacttgggccagaaattacgataggacgggacataacgcaaaggtttactaatctttatccgaagtaaactgtagttatcaactaaaaagaaacgccattgtgtatccatttatgctaaatgtatttttttttttcttttttatgtgtttccaagctttttttcgaaatttggaatgtaccgatgagtacggttgctattagcatcgacgccgccggaaagacgcatcacatatttcgagaaccgaaacttcctgtcgatataacctacacttcaaatagctatcatttcgaatcgtcgcagttttgacaatcacatttatacacttactgtcgttttttatgtaaaggctgtgaaaatttcaccttattaatgcttatagagcagagtttaggatgaattttgcattgtagcctgccgtgagcacacacaaggagtagcagagcagtagtcttgccaaaggattatgacagatgatataccttgcacaaacgtgatagcaaggaactgcaaaagttgatatcgaacaatcattattcacggtgtgactttttctgtttccgttgcttttctagctactctaagataaagggcacccaagattgacaaatagttgtagattaaacatagattgcaagcagtgaaattcagaggataatcttttatcgctgtcagtacataccatatgaaaaatgctatccaaggtattgctgaatatagctttcaaggtgctgttaaccaccgccaagagagcagttgatcctgacgatgatgatgaacttctaccttccccggatctcccgggtagcgatgaccctattgcaggtgatcctgatgtagacttaaaccctgttacagaagaaatgttctcttcatgggcattgttcattatgttgctcctattgatctctgcattgtggtctagttactatttaactcagaaacgaattagggcagtgcatgaaactgtgctttctattttttatggtatggttattggcttgataataaggatgtcccccgggcattatattcaagatacggttacttttaattcatcctacttttttaatgttctattgccgccaattattttaaatagtgggtacgagttgaatcaagtgaactttttcaataatatgttatctatcttaattttcgccataccgggcaccttcatatctgctgtggttattggaatcatattgtatatctggacctttttaggactagagagtattgacatttcattcgcagatgcaatgtctgttggtgctacattatctgctaccgaccctgttacaattctttcaattttcaatgcgtataaagtggatcctaagctatataccatcatttttggagaatcactgttaaatgatgccatctctattgttatgtttgaaacctgtcaaaaatttcatggtcaacctgcaacattttcgtcggtttttgaaggggcaggcctctttttgatgactttctccgtttcgttgttgataggcgttcttataggaattcttgttgctcttctgttgaaacacactcacataaggcgctatcctcaaattgagagttgtttgatcttgttgattgcttatgaatcctattttttctccaacggttgccatatgtccggtatcgtctccttgttattttgcggaattactttaaaacattacgcctattataacatgtcaagaagatcacagatcaccattaagtatattttccaactattggcaagattatcagagaatttcatctttatctatctaggtttagaactttttactgaagtagaactagtctataagccactgctaattattgtggcagctatttctatatgtgttgctcgttggtgtgctgtgttcccattgtcgcaatttgttaactggatatatagagtaaagacaatcagatctatgagcggcataaccggagaaaatatttctgttcccgatgaaataccctacaattaccaaatgatgacattttgggcaggtttacgtggtgctgttggtgtcgccttggcgttgggaattcaaggtgagtataagttcactttattggcaacggtccttgttgttgttgttttaacagttatcatttttgggggcactactgcaggaatgttagaagttttaaatattaagactggttgcataagtgaagaagatacatctgatgacgagtttgatatagaggctccaagggcgataaatttattgaacggtagttctattcagacagatttgggcccatattctgacaacaattctccagatatttcaattgaccaattcgcggtcagcagtaacaagaatctccccaataacatatccacaactggtggtaatacttttggaggccttaatgaaactgagaatactagccctaacccggcaaggtcttctatggataagcgtaatttgagagataaactgggaacaatctttaattccgactcacaatggtttcaaaattttgatgaacaggtattgaagccagtattcttggacaacgtttctccatccttacaagattcggctacgcaatcacctgcagatttctcttcccaaaaccactagactttaaagtgtatggtttccttgtttctaatataaatatattaattaagtctttatacattctctcttactcaacgccgaaggaatacccttctacactttattcattttaaatcatgtactgttatatacacgctagtaggattgatcttatttaatcatatttcgcacgttacccgactgctttcagttttgccgctttgtgataatgaggaatttcagctagcttttaatgagccgatactaaatcaccatgattttgggagaggaaaagaagaaaaggtaaaacaacgaatatttttcaaataccttagttactgaatatccataactactcgtataattggtgagaaaatagtgcatatttagtttactttttgcctttgattgaaaatatatattcatggtgctttttactcggtgtgaaaaggcaagaaaggagaaactcgccgctggttataagcccttagttgattatttgattgattgtgatactcccacatttttagaaagaattgaggcaatccaagagtgggaccgatccagagatgatctttatgtttggattcccattctagacagaatggacgggctgttgttaaaagtggcagagaaatataaatacaagcaagaccccaagaaggagtgtgaagtcaaattggtggaaatggaagcgcatgatgttgattattgtttgaaaatgctaaagtttactcgtcgactacttctaaatacagaaaacaggtttgtttattcatctggagatgttttaatgtatctactgaattgtccgaattttacaataaaactagcggtcatgcgaattttagccattttaggggaaaggtttgtgattgcgagagaaaaaatagttgcacataacatatttggagatcacaacctcaggaaaaaaactctcaaactagctttatctctgtcatcttccgtcatggatgaagacggagagcacttttctcttgtcgatctatattttgataagaaaaaagtgcctcaaaaatggagaaagttgagatttacacattatacttcaaacgactttaaaaagtcaagccagcaaaaaaataacattaatgaaacccaaacttccattaagaaggtaactatgacgacccaagaactgtgtgaacactcactacagcaaatatttgataagggtatggcccttttacccgcagaaagttggtttgatttctcaataaaagcttcggtggcgaaggccttcagtgatgattcaggtgaaaatatagatttgagaaatataattattgaaacaaaactgaatgctattgcatttgttaacaccattttctcgcctcctcaagtaagctcgaagttatttgaattagatccgtatgcttttaatagtctaactgatttgatatcgttgtctgaaaccaaaataccaaaagagctaagaacggatgctttattcacattggaatgtatatccttgaagcatgtctggtgctcagacattatcagaaatctcggtggtaacatatcgcatggtctgttgtttcagattctccgttacattgccaagacattgagagaagcgacagacgaaatcgatgaagaatataatgtgaggttcttttacttgatatcaaatttagctgacgttaagcctttgcatgaatctcttttcgccgcgggtttaatacctactttattggaaattgtatctataagaaattgcccatataagcgtaccctcgcatctgctacccatctcctagaaacatttatagataacagtgaaactaccactgaatttatcgaaaatgatgggtttactatgctgatcacttcagtcgccaatgagattgatttcacgcttgcacatccagagacgtggcaaccgccaaaatattcagtggtttattattcaatttcttttagggagttggcatatattagaagtttattgaaactcgttctcaaattattaagcacagactcaggggatagaattagaaatttaatagattcgccgatacttgtttcattaaagaaaatcctagaaaataaacttgtattcggtttaacattaataacttacactctggatgtagttcagaaagtaataaatagtgagcctactatttatcctgttctggttgaagcaggacttattccatatgttatcgataattttccaaagttaattgggccttccgccgaattattaagtttacttccagatgtcgtttctgccatatgcttgaatccagaagggctgaagcaagttaaagaaaagggtctcataaacaatttgtttgatttcttactcgatgctgaccacgcgcgtatattaacaggtggagatcgttctacggaatatggtactgacattgatgaattagcaagacattatccagacttaaaggcaaatatcgtggaggctttgtgtaacgtcatcagaaaaatgccaagtacctttagaaatgaaagagagtttctttttacttcaccaaaagatcaaaagtacttttttcacagaaaaaatgaggaaatattgacagataaagaggaacatgaacctgcatactgggagctattagataagggaactatgctggacacatttaccagtgttttgtttggtatgtctttaggaaatggttctttttcacaggtgccacaacatctggaagcgagagattttctggcaataatatttatggaaaatcctccttatgaatactttacctccgtggcaatctcaaatgttactgaggtcctccagtatctggatgaaaaatacgaagactacgcattcatggatgttatgaaagtattgaacgatcaattggagaacctgaatgattttttgaatagtccaaatgatagaagtttctttttagaaagagatggggaaaactcggtgcgttcatgccattcaaaactttgtcgacttgccgctattttgaacattgttacgaatgtatacattgacctcactaccttatcttgtaagagaatcatgcagatctattcttattttgacaaaagaggattttctttaattaaaaacttaaagttgctattccagaaatgtgcgttggaggaaatgtacatacgccaacatatgccagattctgttattacagaaacaatgccgttgcctatagtggatgtttccggagatggaccaccacttcaaatttatatcgatgacccaaaaaagggtgatcaaaaggggaaaattaccagcgtaaaaacgagaaatactcttcaaatgcgaacaatactgtatacattacaatcaaatactgcaattctatttcgctgctttttaaggttaagccactctaggaatatggatctagagcataaagatttgacgacagaagttcatatatttgagaacgttgttgaaaatgttattgaaatgttgaaggccaccgaactcgaaggtcatctaccgtatattctcgttttattaaacttcaacacctttgtgtttactattccaaaggcttcccctaattccactgaaatattacaaacaataccggcttatattttctatcaaaaggggggctatttactttatttgcacattataagggatctctttacgagaatgacaaaaataaaagatttatcctcacttgataacataaactacatagatgagtccaacggtatcctaaccttaagctgtttaattaatgctctcaccttttacaacaaatcaatgcaaactgaaaccatggagaatgtccaaagtattggtaagtattacgtttcaatagatgacgattataatattatgaaagctttaacagttcctattaaggtaatggctctcgcaatgattttagatttggataaatcggatagcctcttcaagacacagtcccgtaatgtgccttactcagttttcaagcaacttcttagtatgctcaaaaatatattcactaatgtgaacatctataccaaggaattatatgaattgcattgggacctaatattcccaccaattaaaaaaattagcttgtttgagcaagtcggcattcccggtgatgttgcggcaaactatttaacagatactggtgatgatcttcctgcagataacagtattggcctgttttcgcctgaacaatgggaaaaatataaaaaattaatcggtgaagataaatccatctactatccacaaccaatgcaagctcagtattacaaaggatgttcctcaaaagaattagatgagctgagagatacctttttcaatgacggtttaccatctaggatcttcactgtactccctttctatcctaaacttgtaaacgcgtttgcaaaaactttgctacaaatttttacgaaatacgatgaacccactgaagtgtttgctggtagaatcttagatcgaattttagagacagatctagatgaccctgctactttatcttccttaatccatttatttggtatattcctgaacgagaaatatatttatcaaaaggcttcgcatttaatgcaaaggttcattgaatatcttgagaagtctctgaagccagaacatgttaatacgccttggttttcgaaagctctttacgtttacgaaattatactggcgaaatctgagcttccacacctcgaagagctttccaaggatgttcttctgagatatccattgctttccatggcgaaagtctttcgcataccagaccctatgaagcagaaattatttgacatactgatcagagtttctgatatttccaatttttattctgcactggcaacatcacgcatacttattttctactctagggatgagttgtatgctaacaacatagctagatcgggaatattatctagattgttgaaagtaattggaagtttccaaaaactagacaaaataaactttttagagtcatctttccttttattaaccaggagatgttttgaaacgactgaaaatgttgatgctttaatacgtgcagaaattaatagaagctttacagcaagaccgttaggtggtggggatgatgctgtacgtgagttaaccactattctagaagaaaaggcgcatgtggtcatgcgtagtccctctcaatttattgacgttctttgcgaaacagctcggttccatgaatttgatgatcaaggtgcgttggttgattactcattgaaaagatttcttggtgaaaaagataagaatacgcaagcctcaagtacagaaaaatcagatatctacgagagaacggggatcatgcatttattactgtcacaacttatggctgcttctgagaaagactggttgtctgaaccggccaactcctcggatttgcctgagaacaaaaaagcccaattggacccatcaagaaatcctgtatgtgcttacatgatttttcttttgaagcttttggtcgagttagttagcagttacaatcaatgtaaatttgagttcttaactttcagtagaagaaacacatatgcagaacgccccagaccaagaacaactgctattaactttttcctttatagattattagacaaacctgtcggaactgaccacgataagcatgaagctaaaagaagagaggttattggaatgctagcacgttccgtaattattggtttcttggctactgttcaagatgataggacgaccaagactgacgtcaagcttgctgatcctcacatgaactttattagaaaatttgccattgaagcgattataaaagccattcgcaacgccacttcctcttctaaacttttggaaagtaatcatttaaagttagatatgtggtttagaatcattacatcgatggtttatgtccaggctccatatcttcgccaactacttgattcaaataaagttgaggcagatcagtaccaattgtgcaaactggttatagacctcggtcttccgtcagttatcacggaagccatggccagtatagacttaaactatcctttttccaaaaagattttcaacgtcgctgttgaagctctaaacacaattagttcgacaaggaacaatttttctgagcacttcaaaattgaagatcatgatgaagttgaagacgaggttgacgagtctgataaggaagagatcccggatatgttcaaaaactcagcgctgggaatgtatgacgtagaggacattgaagaagacgacgatgacgacacatcattaattggagacgatgatgctatggcatttgttgatagtgataacggatttgaagtagtatttagtgacgaagatgatgatatgggagaagaagatgcagatgatgctcgttcagattcggaagaaaatgaattatcttctgaaatgcaatcaagtacagcggacggcacggatgtggactatgaggttgatgatgcagatggactaattatcaatattgaccagccctcaggagatgatgaagaaatggcagactatgatgctaacattagccattcttctcacagtgaaaatgaagatgacgcttcaatggacgtcatagaagtttacgacgacgagctaagttctggatatgatgttgatttaagcgattatgacgtagatgaatctgattgggactccgggttatccagcctatctatttctgatgaagatagtgaaagtagcgaagatgagcctattaactccaccagaatgggagattcaagaaggagatggctgatagctgaaggcgtggagctaactgacgactcgcaaggtgagagtgaagaagatgatagaggtgttttccgtggtattgaacatatattttcaaatgagaatgagcctttgtttagagttcatgacgaaatgcgtcatagaaaccatcatcgctcaatcaatcgtacccattttcactctgctatgagcgccccctctttaagcttattaaatcgtggaagaagaaaccaaagcaacctaataaatccactagggcctacaggattggaacaagtggagaacgatatttcagatcaggtgactgttgctggttcaggctctcgcccaagatcacatcatcttcacttttcggaagttctagtctcaggcagcttttttgatgaacctgtcttagatggcataattttaaagtctacggtatccagatggaaggatatattcgacatgttttacgactctaagacttacgctaactgtattattcctactgttatcaacagattatacaaggtcagtttagctttgcaaaaggacttggaaaacaaacgtgaacaagagaaattgaaaaataagaacctactattcaacgaggctaaagtagaaagccataacagttctgatgctatatcggtagaacaagacgatatacaagaaagcaatgttactcatgatgaccacgagcctgtatatgttactattcaaggttccgaggttgatataggtggtacagatattgatccagaattcatgaatgcattgcctgatgatataagagccgatgtctttgcacaacatgttagagaaagaagagcagaagctaggctaaattctgatcataacgtacactccagagaaatcgattccgattttctggaagcaattcctgaagacatcagagaaggaatattggatactgaggcagaggaacagagaatgtttggtagaattggctcttcggccgatgtgattagagcagacgacgacgttagcaacaatgacgaagaagttgaaaacggtttggatcatggaaatagtaatgatcgcaataacgccgaccctgaaaagaaaaaaccggctagaatatactttgcaccattaattgatcgtgccgggattgcctcattgatgaaatctgtgtttatttcgaaaccttatattcagcgtgaaatttatcatgagcttttctaccgtttatgttctagcaaacaaaatagaaatgatttgatgaatacatttttatttatactaagtgaaggtatcatagatcagcactctttggaaaaggtttataacattatttccagcagggcaatggggcacgcaaaaaccacgaccgttagacagttaccatcagattgtaccccgctaacagtggctaatcaaactatcgaaattttgcaaagtctaattgacgcggattctaggctaaaatacttcctgattgcagaacatgacaacctgatagtgaacaaagctaataacaaatctaggaaagaagccttacctgacaaaaaattaagatggcctttatggcatttattctcacttttagatagaaagctcattacagacgaaagcgtattgatggatttgttaacaagaatattacaagtttgtactaaaacattggctgtcctttctacaagttcaaatggtaaagaaaatttaagcaaaaagtttcatttacctagttttgatgaggatgatctcatgaaaattttatccatcattatgcttgatagttgtactacaagagtatttcaacaaacacttaatataatttacaacctctctaaattacaaggctgtatgtccattttcacgaaacatttggtatctttagctatcagcataatgagtaaattaaagagtgctctcgatgggctatcacgtgaagtaggcactatcaccaccggaatggagatcaattcagagctgttacagaaatttacccttccaagttctgatcaagctaaattattgaaaattttaactacggttgattttctttacactcacaaaagaaaagaggaagagcgcaacgttaaagaccttcaatctttatatgataagatgaacggcggaccagtgtggtcctcattgagtgagtgcttatctcaatttgaaaagagtcaagccatcaacacttcagccacaatcttacttccgttgatcgaatcacttatggttgtatgcaggcgtagtgacttaagtcaaaatagaaacactgcagtcaaatatgaagatgctaaattattggatttttccaaaacacgtgtcgaaaacttatttttcccatttacagacgcacacaagaagttgttgaatcaaatgattcgttcaaatccaaaactgatgagtggtcctttcgcattattggtcaagaatccaaaagttttggattttgacaacaaaagatatttcttcaatgccaaattgaagtctgataatcaagagcgtcctaaattacctattaccgttcgccgtgagcaggttttcttggactcttatcgagccttatttttcaagacaaacgatgaaatcaagaattctaaattagagataacattcaaaggagaaagtggtgtcgatgccggtggggtaaccagagaatggtaccaagtactatcgagacagatgttcaaccctgattatgctctttttcttcctgtaccatcggataaaactactttccatcctaatcggacatcaggtatcaaccctgagcacctttctttctttaaatttatcgggatgattatagggaaagcaattagagaccaatgctttttggattgccattttagtcgtgaagtatacaagaatattttgggtaggcctgtatcattgaaggatatggagtctcttgatccagattattataaatcattggtgtggattcttgaaaacgatatcacagatattatagaggaaactttttctgttgaaactgatgattatggtgaacataaagttatcaatttgattgaggggggcaaggatataatagttacagaggccaataaacaggattatgtgaaaaaggttgtcgaatataaacttcagacatctgttaaggaacaaatggataactttttagtgggtttctatgcccttatatccaaagatctcattacaatatttgatgagcaggaattggagttattaatcagcggtttgcctgatattgatgtcgacgactggaaaaacaatactacttatgttaattacaccgcaacctgtaaggaagtgagttatttttggagggcagttagatccttcgacgctgaagaacgtgccaagttgttgcagtttgttaccggtactagtaaagttcctctaaatgggtttaaggaactaagcggtgtcaacggtgtttgtaaattttccatccatcgtgattttggttcatcagaaagactaccatcatcacatacctgtttcaatcaactgaatttacctccttatgaatcatatgagacattgcgtggttcactattattggcaatcaatgaagggcatgaagggtttggtcttgcctgatcatttttcgtgtaaatttatagcgccatgtaaccaagtattttagaacgtcttttatttaaacctttaaccatacaacacttgcccaaggaagaggaacagaaggattttttaatttgtaaaaatgcgtttaatcttaacgaaacataatacagatttcatgtgcatttcgccctttttttttatgacaagcaatatcttccaaagtttctcaaaaaggtatgatgtaagatacagtaaatgatatgtaaaaaaagtacaaactccacttataaaaccatattgaaacagcgaatggttataatattttacataaagattaatagaatacacttacctaagaaaaatatccgtgaaaacaaattacaaaattaaaagtcacttatcacattagaaactcaaatacgaaaacaaaacaaagaaaagtaacaaaaagtggtttgaagacggaaatacgatcattctttccattcccaacatgtcatgatctctccattttcttcaagaagatataattctatattctctgattgctctttcatgattttttctttcgtttgagcccatagattattctgttcttttatatttggtatgtcgctcaataaagtagctcttagttgaactgttgtcagaaaaggttcttcacctttgttcttctttacatctttcaatttatcaattgcctcttttaccaatttctcaattatctgctctccttgaacgtaattgtcaagtgtcgattgtatttttttgataaggaaaaggacgcctagggtgataaataaagaaccaccatatttcgttatatactcctgtatatccccttctaaatgacattgcaacgtaacccatttttttgaagttgaacgataaatatagttagtgttattagatttagatttctctctttttccattagtttcaaaatctaatggcagccagataatatcatcttttttctttaatatttcaagcacatttttccaatgatcattgaattccctttgactttcccatgacggtctagaatgagagaatatatcatataatttggtttccgtttcaccactctcaaagagattctctccttcaccacattcatgttgtgcattcttctttttaagatattcatttactttccaaaccagttcatcaacctccttttctttactttcatctttggcacaatattttggaaaaggaataataccatacgtttctaaaatagaacttttaggctcatagcctggttcacactcaacattcataaaagaagaacatattccatgctcaggacattcgagacaatttggtcgataagcttgcaacactgaatctaccctttcagtctgagggaaagctgagattgcaagagatttcaggggcttttcatgaccgcaatatcctacttgaattctctgttctcgataccaaagaccaaaaagaataggacatattattgaaaggaaaatagcaccattccataaccaaatgaagagatgtgcaataaacggtttcataatatctatccctcttttagttttgttggcaatgaagtgcctggtgcgaccttttggacttcgtatattttttttcgacgataacctactagtatcctcttcgtcttgattatcaaaagtttctgatatttttgttagttcttcttttgcttccttcacctcaggttggacttccaaattgatattctccatcacctcactttcatttcttgtttctgctccagttgaaggaccaacaggctcttctgtttcgattctgatagacgataagtccgtggattttatagaatgatcataattctccgtagctgcactagctaactctttatttagttgagctaaaaattcgtttgatacttttaaattcggcaattctggttttggaagctcttttacccttggtttgtcatccgaagaatctttcttatgaagttcttctacagtttccagttcagaagttaaatcagcagaagttgctttcccatctgacttagattgtggaggagactctggtggtttattggccttactagatcttttctttcttttctttttaggagacttctcttcctgtatttgcatcttcgcttcattatccgtactaatttgttcccttttcctcttgttagtttcaacattttcatctttgacagttttactctcactagaacttgattcaagctttttactctttaatgtctttttgcgatctgcgttttttgccccagacttcacaaccttttgaatgctagttctaacctttgaggcctcaggtgaagattggagacgttgcctcactttctcctcaaacaatttcaccaagacaggcttcctagcgttggcagggaacgcaacatcattttctaccaaaactcttctcaattggctgaccttcagcgttttcggatcaaggtttctgtgatccattgtcgattagtgaagataggaaacttccttttctactattatgtccgttaaagttcatcctaccgtttctttgctgttaaaatctctcttcttttttatttttttcaaacttatctcttactatttatggaaggacgatcaagaaaatgtatatactatcccttcccctacgcatacagaatatattaaaatgaatagataatagaaacatataccgattgtaacatgagtttcgtcccagaatataaattgcttgaaaaatttaatactatttagtaagcaggatcactatcgtcaccagaagcccgcaatgtggccagatattctcctcttgatatcttgtcctcaatggcctgaatggtgtagtcactaagagtttcttcatagggacccaatatttccactagcgttgtttttgaaccgcttttgccatcagatttgcatcgagatgtatagggcttgcctaaaggaattatccacataagtatgttagaacccataaagtcttttatattagctaagattgactttttgtcccagaaagagtgaaattcagatctatcgaactctaccacaaacctcaacttgtttgcttccgagtaataacaaaatatcttccttgttccaaattttttccttttgctatctatgatagcctccaaagacgtcttgttttgactcatgtaaaaaatactcgatgccaacaaacttgcggttaataaccatccaaggatggcaaacactaacgttgaaattatatttgcgtttaaattggggctataattatgattgtgttgagtaataattcttatgtaaacgcaaatagacacccacatgataagtaaaagtgttgaaaaataagcagcaaactgcacaaagagtctataattgtctctaccaataacagtccctatccacatgcagtaatgatcaaagcgaggaatgcagtggcctagttctgaagaatgatgcgttcgttccattttcagactttgacattcactgcaccatattgggtatccgtgaggatcagactgataacacttaggcggaaccacagcatcgtattccactgaagtgttttgagaagtgttgctagtcttctcttcagaggctataggaaggatcaaaaaaggtgctacgtgcggttgggtacctggaccgaccaagataactatttgaagccatatgaaaatcacgactacgtctaggaagcataccgcacaaataagaccaaccgaaactgatttctgacgaagtcgtttgtcgacttgctcgtaacatagtttatggcagtaagcccacgtaccgtagcacagtaaaccgagcacgataatcggtaagatgaatctaaaccatgacctgcgcctgattcgaatattccatgatagagccattcatatacaacggtttaatttctgccgtgtcgcgatgaaaggaccttagctaggttctgaaaatattacaacgggcagatatacgcctaattagttgttttgtttgagtgctgtgtttatgctactattatttaaaacgtaaatagtggaaaaaaaaatcgactaaatggtccaaatcgggccgttcgctcgtaaatttgttcttaagcactaatactaaagagagtatacaacagaacagacgcacaagacagcactcatcatcagctaagaaactgaactgcttgttaaaatttgagtttgtttcctcttaggatttgcagcattagtgggcccccgcacacaagtaaatataagtgaaagaaaaatgcttatggatgagtatgaggaaaacaaggacatgtgtccgatctgtaagacagatcgatacctttctccggatgtgaaatttttggtgaatcctgaatgctatcacaggatctgtgagtcgtgtgttgatcgaatatttagtctcggtcctgcccagtgtccatataaagggtgtgacaagattcttagaaagaataagttcaagacccaaatattcgatgatgtggaagttgagaaagaagttgacatcaggaagagagtgttcaatgtgttcaacaaaactatcgatgacttcaatggtgaccttgtggaatataacaaatatttggaagaggtggaagacattatatacaaactagatcacgggatcgatgtggctaagaccgaggagaaactacgcacctacgaggaattaaacaagcaactgattatgaataacttggagagaagcagaacagagatagaaagtttcgaacagagacaaaaattcgaaaaggagatgaaattgaagaagcgactgttggaaagacaaatcgaagaggaggaaagaatgaacaaagagtggacaaagaaagaaatcgtcaaccggttgagtacgaccacccaggatatcaatgaaacaatcgaaggcgttaaaaatacggttaaattgaaaaaatcgtccgctagaaggaaattggaagaactaaatagagttctgaaaaacaatccatatttcaattcaaatgtgaacgtacagaattcgagactcaaagatgctgtaccgttcacgccgtttaacggtgatagagaagcacacccaaggtttacgttgaaaggttcagtatacaatgacccattcatcaaagatcttgagcacaggaaagaatttattgcgtctgggttcaacactaattatgcgtacgaaagggtgttgacagaggcatttatgggcttaggatgtgttatatccgaggagctttaaaacatcaggatagtgtgcaacgtggcataagctatgtaatcaactactttttattttctatgtacgcatatacatgcattcacgatctgtttcagtgttcagaaaaaaggcacctactgctacggttggcccatacctttattctttgttcttgttacaaacgagtgtgtaattacccaaaaaggaaatttacatgttaaatgaaacccagtaatcagaaaaaacagttaagaaacctaaaatggtagagataaagatacagattcagtggttgctgaaaatcaagtaaaaaaatgaaatagagtcttcatatataaaccgccagaaatgaattaatgagagggatctgtaactgtttctcggataaaaccaaaataagtacaaagccatcgaatagaaatgcaaccatctaccgctaccgccgctccaaaagaaaagaccagcagtgaaaagaaggacaactatattatcaaaggtgtcttctgggacccagcatgtgttattgcttagtttctgcgtacaaaaacgttgttctccctcctttatcttccttttccgctacaccaatatatcatgtttgttcgtaatatttctttttagacctaataataaatatcctaagtaactatattatataaaatattttgataccctgtacctgcttttgttatcgttgtacatccatgcacacgctcatatatatatatatatatatatatatgtatatgtacatataccgcttaccacctaccgtgaagtatatgtaagggtcttcgcacccggatatcccttgtgggatcttggatgcggatggtgagtgtaaacaggcctcataaagctgtctctgtgtgcggaagatgtcgtttcatcggcttcgacctcctccttatcttgcttcattgtttcttcgtaagagggcggatctacgggcagcggggtcgctgtctccttgtatgcatgcttatttatatcactctttccgctatccatcataatctgtttttgtttatgtgctttgaatactcaacacataaaataatatccagttaattgtcgtctgtccattgacgctttgcctttgtccctttagactgtctttattgtgaaatatgcacggctgagaattacgtatacagtgactatcgtatggggcgacaaaagttcccagcgagaaacaagatgaagcagactggggcctgcctgtatggagggaagcataagttaatatacctccagatatttgcagattaggatactgaactgacgaagacctacgctacacaacgaagataacacatgctggcacaaacattcaaaaaaccacacagagccgttctagaacaggtatctgggaccacggtcttcatcagaaataagagaacaaagagcaagagctcactgtcacctttggcacaaagggtcgtcacgcagttgagtgtgatgtctgcaagcagaaagcagcccaagttgctgaagctggcgcgtgaagacctgattaaacatcagaccattgagaagtgttggtcaatttatcagcagcaacaacgggagcgcagaaatttacagttggaattacaatataagagcattgagagatctatgaaccttctacaagaactcagccctcgtctgtttgaggctgccaatgcttccgagaagggcaagcgattcccgatggaaatgaaggtgcccactgacttccccccaaatacgttatggcattataacttccgaaaatgatagcgtgagcgaacgcttgactgtctcctgctgtaaataactgatgatcaatagaatgccacgtatatatggacttatataattatatgtacatagacatataaagggcatgtggtaattatgacatgaactgtatcactattgacgttttttttactgctttttcccatccctgcaagcgaaaaaaaaagcaagctgactcttgtataaactgcaaggactcattgattaaaagtagatttacattacagactaaaggaaaaggcaaactataccggctataccacattcgttcaaaaatgccctctaccacgctactgtttccgcagaaacatattagggccattccaggcaagatatacgcgttcttcagagagctcgtcagcggagttattatatccaagccagatctaagtcatcattattcttgtgaaaatgcgacaaaggaggaaggcaaagatgcagcagatgaagaaaagactaccacaagtttgtttcccgaatcaaataatatagaccgttctttaaatggtggctgctctgtgatcccttgctccatggatgtcagcgatttgaacacgccaatatcgatcacactatctcctgagaatcgtatcaaatcagaagtaaatgccaagtcactgctcggatcaaggccagaacaagatacaggcgcccctatcaaaatgtctactggtgtcacaagctctccattaagtccatcaggctccaccccagaacattccaccaaggtcttgaacaacggcgaagaggagttcatttgtcactactgtgacgctactttcaggattagaggatatctaacgagacatattaagaagcacgccatcgaaaaggcgtatcactgtccattttttaacagtgccactcctcctgatcttagatgccacaattcgggtggttttagcagacgcgatacttataaaactcatttgaaggcaaggcacgtgctgtaccccaaaggtgttaaaccacaagaccgtaacaagtcgtccggccattgcgctcaatgtggtgaatacttttccaccattgaaaatttcgttgagaatcacattgagtctggggactgtaaagctttaccgcaggggtataccaagaaaaatgaaaaaagatctggaaaattaaggaagatcaagacatctaatggtcattctagattcatatccacttcgcaaagtgttgtagaacctaaagtacttttcaacaaggatgccgtagaggctatgaccatagtggctaataacagttcgggcaatgatattatatccaagtacggaaacaacaaattaatgttaaactcggaaaactttaaagtcgacatacccaagagaaagagaaaatatatcaagaaaaagcagcaacaggtatctggatcgacggtaaccacaccagaggtagctacacaaaacaatcaagaagtggcacctgatgaaatctcatccgccacaattttttcaccttttgatactcatctactcgagcccgtcccttctagttcatcggaatcttccgctgaagttatgttccatggcaagcaaatgaagaattttttgattgacataaacagcttcacaaatcaacagcagcaggcacaagataatccttcgttcctgccactcgatattgaacaatcttcatatgatttgagcgaagacgcaatgtcatatcccatcatatccacacaaagcaaccgtgattgcacgcagtatgataacacaaaaatctcacaaatcttacaatcacaactaaatccagaatatctcagcgaaaatcacatgagagagacacaacaatatttgaatttttacaatgacaactttgggtcacaattttgattaaatataacacgggataaaaataagggtatcatattggaaagccgatgggtaaaaattattgagttaataaatggagacaatattaaaaatcaggtaacaacaaataaaaggttataaatgtactgctgtatactatataaaaacttttagcatgactaattaattttcatactactatgttaaataaaccaagtgattgcaacaccaatattttattattgatcttcagcgcatagagtcgattcgtagatattatcacttttgacgtttgtgatttctttttcatgattgattaccgatgatgctataacaaataaaggtcaaattttgaaaacaatgaaaaataagtagtaaacaaataaatgcacatttattgacactagtagagtgtaagaggaaagtaatttttagaacgctttatacacctctatcatttattttttttttggtaaaaaaaaaacagtaaggtgttaaccatatatcatattctgccatggcttatgatgaagatgatggagagataaattttaatgaacttgtggggaacttactaagctcacataaccaagagggacaagaggaaggagaagtgcaaggaggagaacaggaaggagatgattttgaaaaaatatatcctaccagtgaaaatatagaaccaaagcatccagatgacagccagcatatgcataattctcctgaccagaatatcgaaataccacattttgtcgacgaagaagatgagctagtatctgtcgttgcaaatgcggttcaaaatatagacgatgagcaagccaaaccggaaaatcatctggaaaatggatcagaacatgtaacatcggatacagcggatgataatcacgaaaaagaacaacagcaagaatgggctcatatcttacagcaggaaatattaaaatcagacggagagcccttgcgggagaatacagaaaggcgtgtaagcactagtcagcaccatccctctcagcgtactgatgacgctctcgaccaagatgatgaaaatttgaggatggctatcctagagtctctacaagaattaaacacaaatgaggaggaagagaaagagccggaaaaacatgagcatgctgccccgaatgataagttgagcagcaaaaaatcttcaaagaaaaagaaaaaagataaatccaagaacagagaatcatcaaaggataaatcctcaaagaagagtaaatcttcgagccattccaaaaagcatgccaaagaccgtaataaagaaaagcaaagtaaacctactaataatgaaaatacccttgatttaagtaatatactagaaaatctgattcatgaaaatgacaatgctgcaatagacactgccaaacaaacagttgatattcaagataactcccatactgataatacaaacaacgaagatgtggaagcgcaagctttagtggaagcgacactaaaagcatttgaaaacgagctgctaagctctgcgccaaccgaggagccttcacaagaacagtcgattgggcctgtatcttctagaaaagcagttgaaccaccacgaaaaccgactgcagacgatattccattggctatgttacaggcttttaaaccgaaaaagaggcctcctcaagagaagaaaaaaacaaaaagtaagacatccaaggctgcatctacagcaaataaatcacctgcatctgaatctacctccaagaaaaagaaaaagaagaaaactgtaaaggaaagtaataaatctcaagaagcttacgaagatgatgaattttccagaatattagccgatatggttaaccaagtggttaacacttcattaaaagaaacatcaacgcatactgccacacaggataataaattagaaagcgaaagtgattttacttcccctgtacaaagtcaatatactactgaggatgcaagcacagctaatgatgactcgcttgacttgaatcaaatcatgcaaaacgcaatggctatggtttttcaaaatcaaaacgacgatgaatttgatgagaacattgttgaagactttaatcgtggtttaggcgatctgagtgtttccgatttactgccgcatgataacctttctaggatggaaaagaaatcggtgcctaaaagttcgagcaaatctgaaaagaaaacagctatatctaggagagcttccaaaaaggcatctagagatgcctcaagtgtagaattgactgaagtaccttcaaaaccgaagaaaccttccaagacagaagtatctttagaaaagaagttacgcaaaaaatacgtctctattgccaacgaggctgcatctgtggctagaaagaaaagatgggctaaaaacaaagaactaaaggagaaagagaaacttgaacgccaaactgccagagaggaaaggagacataaaaaaaaactagagaagcagaggttggctgaagaacaagaggaactgaaaaaaattgttgaacgaggtccaccttatcccccagatttaagactaactaaaagcggtaaaccaaaaaaaccatacagaagatggactccggaagagctactgaaacgatcacaggaagctgaaaaaccgaggaaggtgaaaaaggaaagaaagaaaaaggaaaagaaaatgaaggtaccttcatctgctttgaagaaaattcctctcttcaactttgtaaagggtaatgttcagccaagtgcaagacatcgtctgaatgacattgaaggttcgctatccactattggattacataaatcgcctgacggtgtccgcaggattctttcgagaccaaagagtgaagatcacgaatggcccctatcagattcatctgcatctcaaaattacgatgcacacctaaaaactgtagtgcataaagaaaaaattcctttccatcccccatggactataccgtctcaaccaccatttgcactacccgtagctagaagaaagaaaataccaaatatcaaaaagtatagaaagagaaccaataattcttttcgtgtctccaaagaaggtacggcaagtactaggaacagaattttaccggccatattactaccgataataaatacattaaaagctgctgcaaaatcgcaaacagctgctggcgccacacctgaggaggcaaggaaacggctggcaaccattattcaacatgccaagtctacagttattagggcagctttacaagcaaggaaaaacagtatgcaagccgctcattctaagggaactaccacagaactggcaacaactgcgtctcgaatgaagaatccgctgaaaatgattcctattttcaatacatctcgagtgaaacaacaattagacaaacaattaccggccagaagtgcaggaacagaaatcagcagctctgaatcccctgataaagccacgcccgatccccactctaattctacaatcgctgggcatactttaaagggcgttactacgccaattaaaatagaagacagcgatgcgaatgttcctcctgttagtatagcggtttcaactatagaaccatcacaagataaactagaacttacgaagagggcagagagcgtagaacctgtggaaaataatgttgaaacagcgaaagaaacccaaagcgtacaagaaattaaggagaatgtcggtaccaaggcttctgaggaagttactctaactgaagacaagacaaatggggatccaaaaaatgaaaagaggatattaattgaatctcctgtcgaaaaaacggataaaaagaagccaggtgagaaaattgctacagatttgaatgaagatgcgagcctgtctgataagaaagatggagatgaaaagtctacattgcattctgatgcagcccaacttacgggtaatgaaccagacagtgtaaacacgacaacaggaaagcccaaattaattgatgtttctctcaaaccgttaaatgaagcaaaaccaaaaattcccatcatatttcccttaaaaagaccgcaaattaagcctgaagttagcgttattaatttagttcaaaatttggtaaataccaaaatacccgaaataaagaatgaatccgttgatttgggaagtaatatcaccgacattctttcctctactatcactaatattctgcccgaaatcacagccactgatgttaaaaactaccagtatgaagatgaaaacgtaaaatacctgaaaaaaacaccaagacaggttttgaatttggatggactagtgcctccatcgggtagatgtattaccaaagctaaacgtgtccgccgcattaaaaagctttctgctgacgccactaccgcaccggaagccgatggaaaggcaaacagcgaatccattacttacacattcgatataccatctccagaagaggtacaaagtaagcgtagtgtagtcctaaaatttgccaaggctagattgaccgaggcggagttgagttgtctaaagaaggagattaacaatgtgaggaaacggagatggagagagatgaactccaccaagaactgggaatatgacgtaaagtctagattaaaaaagcgtgcgaacgcattttttggggaaggagaatcagaaacgaagtctaaatggatcgaagaaagatttcaagaaaaggtaagtcaagaaaagtacaaggatcgccttgaaactactgagacgcaagcaaacaacacgaagattgtgattgacgacaaggagattttgaatattcttgcggtaaacatgaataaccttaacaaagcacgctgtattgaaaaagatattcaagagtcgttcagggaggagaagttagcctctttacaaccaaagaagaagagaaagaaaagcattttacactgaggtgttactagacataatttagttcatatgtccatttctgcataatcatatatacttaaagtagcaaatgtatatagttttttcttccgattttcgaaactaatattagtattggaaatcggcccctgccattgtgcaatttacattattctataattaagcaaacgtgatacgtggatggtaataatagttacagttaaagtaagaccgcttaacatcattccaatctggcaattgctcgtcaagagaatatctggtgtaatcgcatttcataccatatgtagcaacatcgatctcaacaatttctttatatacatcgtaacacaacgatctgtcagcgcctaatccgttgaaaaatgagaaaacgccttctggtttaattaaacctaccacgacatcgtataagtccaatatgtcttggtagtgctcgctaaatgtatcataataaataccatcaaagaaaacttcacctttgtctaataaattattcaacgtatcttgccatcttccctctaaaataaccacattatccttttcataccaaccatccattttcatcttggccaaaacatctggatgagcttcgcaaatatagtgacgatatggttttcgagcttggatgaatgtatcgatgatccccattccaaatccaatgtttaagatcgtagcagaattagtggcctctggatcaggaaataaggtttcggaagcaagttccataatcttggtttcccaatccatcataacaccgtccttattttcctttgtgataagcgcatcgtctttgtactctagttctgtttttaagtacacttgttgatttgccgcggtagcatcgtcatcactaccaactgattcttctttttgaccatcaactgctgtttgaacgctttcctcaggctcgatacctattagttcatctgtatccaagaattcgacgtcgccaccattgagttttctcagtaataattcagcagacacaccagcttccacgagccgtctataaagagggctctccctactttgatttctctctaaaaacaaatcacccactgttttgtcctcgtagtcaataaaattccatccagccccatactcaaaaagaatattcatcatatccatcaccacttgcagttcctcatccttgatatccaagggtagcgatcttgctaaaacgtgtaacggcgttgtgtttgaggttttattgtcgtcagtgctctctctgaattccttatccccgttcctgttcttttcctcatgctcgaaggctgcgacctgctccaaagtatatgtagccggtataccagattttaagaaatgctgcagttttggtacatagtaactttgagaaatgggcctctctgggaaagtaagcaaagcatgtaattctgacatacttgaatatattaaaagtccttggtgtaaacacctagccgttgcaactgctgggtattgtcaatgtcattttgctttacgcttagcttaaaatgagatgagatgagctttgaaaaattttagaaaaagaaaggtgccatcgattctcgccgaaaaaggaaaagaatcgttataatccttcgaatcctatatacactaaacaaatatctgcattggtcaaccccaagcacacgtactgatgactagagatgatactgaaagtgttaacaatataacttccttactcgcagctaatgtcacatattgaggtaacaatggatcgaaacaattttcatgcttacccgcgcggtgatttcttggtagcgaaggggttttcatgaaggcagcagaagagaggtacattgatttgaaagtgtgaggaaacagaataatagtgcctaaagcctaacccaagcaagtaagcagttcttccacgtcttatctattcagaggctgaaacaattgagtgaaaatttaaagagtaggtgtgggacattggtatgacatatgacgtctaggaaaaggtctccgcacgatttcatatttaaagaggaactgggccatggctcttactctactgtgtttaaagctctagataaaaaaagcccgaataaaatttatgccattaaagtttgttcgaagaaacacataatcaaagaagctaaggtaaaatatgtcaccattgaaaagaataccatgaatttgttggcacaaaagcatcacgcgggtataatcaaactatactatacttttcacgatgaggaaaatctttattttgttttggattttgccccaggtggagaactactttccttattgcacaaaatgggtactttcaatgatatatggacgcgtcatttcactgcacagttaattgatgcattagaatttatccattcacatggcatcattcatagagacttaaaaccggaaaacgtccttttagacagggatggtagacttatgattactgattttggggccgctgccaccatagaccctagtttaagcggagattcggccaagtttaactctgacagcaacggctcaaaagacaaccaaaattgcgcttcctttgttggtactgccgaatatgtctctccagagctgcttttatacaaccaatgcggttatggctcagatatatgggcactaggttgcatgatatatcagtttgtccaaggacaaccgccgtttagaggggagaatgagctgaagacatttgaaaaaatcgtagcattagattatccatggggacccaataaccgcatcaataatagcacatcaccaataaatccccttgtaataaacttagtacaaaaaatattggtgatagaggtcaatgagagaatctctctcgaacagataaaaagacacccatatttttcaaaagtagattggaatgataaaatcaaaatatggagaggaatctggcaatcacaaggacaatcgctgcaacaaactactttgggactcccaaatataccgcagaatatactacccaccagacaattacatgtaattgacactccagcacgaagtatacaaatcacaaaacaaaaacgtaagaaaccaacgaaaatttccaacactactagtagcatagtagtatggagaaaaaggcttggtatatcaacaggtaaggatgatttaggcaccgtaccgtccactacgcctgcagtgaccgcccctaatgataccaatgtattaacaaatacggcggcacattctactgcaaatattgccttaccgcctaattcacaatccaatcaagtcaagcgagcacaactagttgcaccaaatagaatacctcccaaagtaccggtaattaatgacaacgtgagaaataagtcaattccgcgcacaaagcctaatgtgccacctttgcaaacatcatcaataccacaaaagttgtcaacatcgtcagcatcgtcagctctatcggcgccgtcaacagagataaggaaccaggacttaacacacactttagatggaagaaactcaattgatattcatgttttaaaacaagactacgtcttcatttatggcattccatatgaacacgaagggcctgctatgtctttgaacagctacaataagatcgataatgatttaattacgtcactagttgcgcagcataaagaagaattaaaaaactcagagtcgtttttacaggtattgactttgaagaagagcggaatgttaagttacaaaaacacagttatggagggaaatgatgatcaagaaaacaaagaacaccagatggctaatatagaagatacagacttgtccatgtacgattttgaattcaatgagttgacaaggaagggttttttaatcctggaaaaatataagaatagaatatggtttatctcgctaccttcatattcaacgttatccaaaataccattcaatgccgtgaagtcttcgacaataaataacaatgaaaattgggtcgattgctttttcagagcaagacaactactagaagaaaagcaaattcttgataaaatcagtaacgtttcctttgatagtaaggcatcgagtgaaccatcatcacctccgcctatttcaagaaaagagcggcctctgagtataggaaataatgtaacaacactcagctatactgcaaaaaatggaagccagaacaatgcaccacaaaacgataatgttggagaagaaaaaccttttcgcatacctagtagtaccaaggataggcccggtgcaaattccactccttcttcaagacatcctagggttttgtcaagcaataacgctggtgaaactccgaaaaaaatgaatggaagattaccaaatagtgcaccttctaccaatacatataccaacggttcggtcccagcttttaatcataggccttctactaatgtagggaacaataagcataatattttaacttcgaagaagcagggatcatccgtattttctccttcatcttctacgaccaagcctcaaatcaaaacaacaggatatcgacagccaacaccttcacctccacttccgcaaatggaattcccaactacgagagaaaagtattctgctccttctaacatggtgatcagtagcagcagatacgaggtcttacatacccttaataacagccaaacaaactttgatagggaaattgctagtaggggtgcctcagcagcatttagaagtttacagaagagtaagaaaaaaaaataacacgctttaataatatttgtggttcctctacttcgaaacaaaaaaatatgcacgagttgttgacgatccagaaaaaccaacatataaatcatatccaaacccttgtagcattaatatccgtatcacttatgtattcagaatgcatgtattttatatatgcccagtatatcttcgattgaagctcttcggcattagtgcattgtatttttcaagcaatgaatgccaaaactaataaaactatcaagacgacaataagaagtcctatacaacaatcgtcgtatttttctttatttttttcgtagacccattccaattgcctacgacctctagccagcttatttacaacaccgtccataccctcgtccatattatccaacaattgtccctggttctctaattcatcccccattgtttgagcttgaatatgcaaattttgcattgtcttgtgaataccatctaaatgaacatcttgttctcttaacatttgttcctgaaacggattggacataccaccatcattgttctcagccatgctggtgttaagtgttgaattttccaccgtctcttctagaggaatagttgtttgagtagattcctgtattcttcgatcaaaacgcaacttcagagcatcaagttgctgttttatatttttaacttgtgcttccctaccactcacgtcttcgttttcatcccttttcattacgattatgcttctgtccaaatcaactattgtttcctcaacatcctttaaaatatcttgtatttcctcctcttgatcgtcatcaccagcagtattgtgacgagttatgtaattgtttatgcggttcaattgctccttggtgtccttaacaacttgttgaaacggatcttcactgttgttcatttgttaaagaaaggatcttagcaatacaattttacagttaaacgtctttcacgtttacttcagttacagggaaaacgtagaaattaaaatgttcacaaaccttgtcagaaagacagcaaatataattttagtatatgttctgtgttgtgtgcttcgaattgtcctatcttctgatatttactactttatgtcgtaggttcgaatatctcgtggataattaaaaactcgataaaaaaagaaaaacagatggtgatccaaacaaaaaaaagccttcataagcaggttctcttaagagaattagggaaacctatacaatgaatgaaagtgagaatagtccccaacataatgaagttacggttcctatggtagaggatacttcaagtaatgctgatattccaatggagcaaattcaacgcgaagacaataagaactacgataaacatgacaatgaatgcttcgatatgaatggcaatcacaataataactctgataacttacaatttgacagtgtaccatcttctgcaacgaaagatttgaaaaacatcaaaagtgtcaccaaccaaaatgtaaaaatagaagaatcgagtagcacaaattcagtcattgaagagtcatctgaacctaaaatatcaaaattagaaaatgtgaaccttgccgcgacggtaggtggttcacaaactagaaaatacctgaatacaaatgtgacaccgcatttattagcgggcatgaggctcatagccgtacaacaaccagaagatccgttacgtgttttaggtgaatatctaatcgagcagagcaatatactgaagagtggagaaaaagagagtaatgctagtaaatgataaccataattatataaatatacatgtgtatttatttttccttactattaaacctttggatatagacaagtggtggaggaaaattggatacaaaaattgtggagaaaaagggccactggaataccatgggcgaacataaaaaaaaatgggggactatcccagttcagaacttctcttgttccatgttgatatcaactttattcatcatttgtaacccatatccgcaaattaaactaataacgccaactttccaaccgttccaaagttggcctctatttgtattagaattgtttcttatcacatcccatatgccattgtatttttttggctttactatcaattcagtggaatctactttaaatgataaccgctgatcgttcaacaagtagtttagttgacaacgacgtaacaggttttccaatggtaacttgataaatagttcaagtgatttagaaaaaaacttcatagtattgtacatgacggtttgagagtatttttcgatatggaattggttgtagatgactaaatcaaacaatttgttgaaaaagctattattgatagattgaagaatagttagggaccacatatctaatggaatggaaactccgtttttacgccatgaccagcatctgattaactgcctcaagcttctagtattagtaaccatattctttccatctgtcttgacattcttcttttttttgaatgatgtaactatcaatctagttcttatcaggtccacaggtaataatataatactggtaaatactcccgcgcctaaggctaaaatgaaggacttagaaatatcaggagagttgatgacctccataaaatatgggtcagggacacccaaaaaagacgagagtaatcctgtgaaccaagtatctatgcttagggaaagaaagttgtaaataaaagtcgtgttgttggccttccatagaccacgaataccctcctgatcaaatagggcgttgattacgtcaattgtatgtagggactgtggtgcaatagtcaaggatatatcagtaggttcatgatgtgaatgatcagtttcttcggccataataggcgcagtagagtttgcctcggcgatcttcctttctatgggaaagaaatctatctcctcctcatcgtaagcatcttcttctccttctctcgcagcgccatctccttcttcatcccgcaaaattattggtgcttgaggtttattcgtgtcaactgtagttttgaagattttaaactcacctacttggataagtagtcttgctacatcaaagggctgttgaatgagcaattgaaaatactttctgaaaaacatatccagcagttgttcaaatatttttcgccatttctggatgttaaccaattccgcccattcaaaattattcaggccagttatttcgccattacttccctccagtgacaatccatcgttaactgaatttgacaatttcttcattggggagcttttaaacaatgcattagccattctctttgtagttggagatgagttgataacgtttagcttagaagcaattgtgtatccgtgcggatctactacaccctcatcgggcttgaaaacagcgctatacccagcattgaaagaatcgggatcataataaggccgtatctgtgcccttgacgttgcttccgtaacattattgttgttcattggggggttgagttaaacctatactattggaaaccaaaaatcggcagagaattaaggcaaatcaattaaaattccttttctctctacctttgctaatattaaaaaccatagttgtaaagggtacttaatgctatattcctgttaagtttcctatttcaccttgttttttccaattcttaccaatttgaagactatgtttttaaacacccaatcattttccacccacacatatattaccctttttttgggtgaagagaagtagtattttgtttttcatgggagtggaagtcctttcaaaactaatccgagcagtagtgctgtctaggcggagattattgaaagtcggcattggctgcagctagcgttttgtttttggtactacctgtcaaacccggcgtctgcctagattgcgcggagggtacgttgaaacttttgcctttccacgtcagtttataatatcaaaagcagcaatatacacatttaatggtttgcccttagtgactattagggcgttttggtgaaaagaaagagtcgctcaaagaaatcaatataaccatggctaaatttttgaaagcaggtaaagttggtacgtaaatttaacagagcaaacgctctaattaagatatcgaataaaaggggactttcaggtgcataagatgggaaattgtacaatctgagggacaaacaatatggaaagcagtacatgattgtattgtcattgtaggaggtaccaattgtgccagtaaaaaagagagggcccggggagcaccacattcacgaccaatcgtgtcgatctgcaaaaaaggcacatggaaaatgtaatttatcagtgttcaacactgagttgaacagatagctatctaatcaatgttaactttccagggaacaaaaagctaaatccacttctcttttatttcaaaatatcattagaaatagaaaaatttactaacaaattttcgtattatcgtagctgtcgttgttcgtggtcgttacgctggtaagaaggttgtgatcgttaagccacacgatgagggttctaaatctcatccattcggtcacgctttggttgccggtattgaaaggtacccatcaaaggtcaccaagaagcacggtgccaagaaggtcgctaagagaactaaaatcaagccattcatcaaagtcgtcaactacaaccacttattgccaaccagatacaccttggatgttgaagctttcaagagcgttgtatctacagagacttttgaacaaccatcccaacgtgaagaagccaagaaggttgtaaagaaggcatttgaagaaagacatcaagctggtaaaaaccaatggttcttctccaagttgagattctaagaagcttttttccgaaacctaacttttttctgtgtactattattattttcataatgcagtttatccttcacataattaaaaattcatattgtataaactaaaacaaacactaccactaaatatttggccatctatctgccatattggtcgtaacacaaaatgcccaatggagcctggtaagttccttattatttaaccctaagaactttattttgatcattgcgtgcaaaatgatattgtttacaagttttttttttccagcttctttacatataaaagggaaggattttgaaattataaatggcatctcaaatcgtctctatatcttttgttaattggattttttaaagggtcaggaagttttttcctttttatatgatgaatatgagtgcatttggctcgagttgctgtttggcttttgccaaatcagtaacggtgtggaaaaactcaagctacctttttttacttttatctgaccttttaacttccccgtagaaaatcttagtaatccttcttacattgtatcgtagcgctgcatatataatgcgtaaaattttctctttttaaaagatgttagtacgttgggtttggcttgttcatttttattatcctttatttacttgtaaaaaaacgaaagtgacgaagttcatgctaagattgaagaaaattatttatcgtatactttgcaggacaagagacacggaagcgacagaaagacagggagtactatcaccatccataatactggagtaacattatgtctcaaagaataattcaaccaagcgcatctgaccaacaattcccaggtaaatctgatggatatgaatatactgttgggcctaagcaagcgataacaagcgaagcttcaacaacatacattccctctagaatatactcagagtctctacttttcaaaaggcaagaagcgtctttatcagcaatggctttcttgttccaggaaatgatttcacagttgcatagaacatgtaaaactgcaggcgattttgaaactaaattaagtgactatggccacaatattggaattcgtctattagaactgctgaattttagggcttctgtatctcctagttctcttcccagagcatctgctttcctttcacaaaatgaatcttcttcaaagttatcaaatgcgtcaaattccccgggcatgttggctaactccagcacagcgacttctgcatctgccaatgaacgactccaagaaaagcaaacagaatcattgtctaactacattacaaagatgaggcgccgtgatctgaaaattctcgatatactgcagtttatccacggtaccctatggtcatatctttttaatcacgtaagtgatgatttggttaaatcttcagaacgtgacaatgaatatatgatagtagataacttccccactttaacccaatttatcccaggtgagaacgtttcttgtgagtacttcgtttgcggcattatcaaaggattccttttcaatgctggatttccatgtggcgtgacagcacatcgaatgccccaaggcggacatagtcaacgaaccgtttatttgatccaatttgacaggcaagtgcttgacagggaaggtttgagatttggctgatatcatctcaaaacatcggtaaatacctaaaaccaagaaaaggataaagagtttgtatatttactgttgatttatagacatatgctcatatattcattacgaagaatgattcttttaattgtcgatttccttgaagtacatctatcatataaaatcattttctttttatattttggaatgtttttgtgctaaaaaaatcattattctgggcgacatacagtaaaataatatttaatatgaaacaaagcgtatcattttgtagacaccgatatcacgtttgaacaggtgaataaaaatgctctgaatcaaactgacccagcgtacgtaataaagaatcctgatcattgcatactttcataaaccagcctttgaatttacaatcttgtaaatagccttcccaagtttttgatattgaattattatgcatgtccatttttatatccccagtgtttgtgtgcaactcaaaatcttcattccattttatcctcttcatcaccaaattctcataaaatttgcatgatttttcgttacccacgactataattattcctggtccgtcatcacgtatacggaggcataaaccctttagtgatagttctttactattcattttcaacttgaatcttatttttgggttctgtaagtttttgaactggaacaccttacaatggtatactgtcggcttttcaacgttcatattgactgcttctttccttcttttaatagcatcttcatgtcttctttcgttttcttccagatgttttctcttcctgaggtccacttggtctttcactactttttcccaggcagttgggtccgttatgttttgatcattctcgaaaacactcatcatgttgcttagtttaactttcggttcaggcttaggtaatagtcctaacttaatttttatctcccgtgcttctcttgccattttccttctatttctccttaatcttttcctttcatgttgcgttagatatgctttgattgatacttttgcctcgttgatcttttcaggtaagggatgtgctacatatcttatagatgggtgctcatcatcatcatcatcgtctacttcatcaatatcttctgctagcttttcttcggcaggcgatgtgccattcatgtcatatttttccatcaactcacccttttcatctaaataagccgtgtcccaccattcatagccatgattattatcatagtatatcttgaactttgacaaatctaataggaacttatcctcatgtaactctaaattgggtaaatcacctgactcaattaattttcttttatctttctcgtcttcttcttgttttaactttctttttaattcttcctcctcctgctgtttttgtaatgttctttcttgggcaattcttttactgatttctcccttttggtaaaacttcagaccccgttcataacgcctgttaaatctgctcgatgagcctcgatcgtgtggatcactaagatagggattttcaccagtttgataagttcttcggataagattcaaatttgaagactttaacgctgagtgaagttcggttttcagaccatggccctgaaacttctcctcatcattggtagtttcttcacgccgtaagaaacttggcttataatatggactattttggcgtttcggattacctttttcataggtatttcttgggggcattttttcaagccaattcaatagatcgcctgatgttttctgtgagtctttttgattgttttacgtcatctggcattctaatactttactaggactatttcttgttattgatcagtgcgggatccagtcagaaaaacgcagatgtgaataatattaaaatttgtatgctaaaaaaattaacatagtcaagaaactttctttgagtcatggctctttactttagaacatataagaacaattcacagtgcctgtccagaggccaaaagcagtatctctagctaaatggatatgttaactactgtttcattggagaagcagtttttaaccttcctgtttcgcgaatatagctgccaagtattatccaaaattggggagtgaagaaaaagtaattatcagcattcattttcgagaattttacctaaactttttcgataacattgattgttcactacgttacatagcaagccagagctagaaaaacttattgattacaatcaatagacttgcatcatacataacttcagggtacttgcaagaattttcctacaaaaaaagttgactacgacaacctaaaggagaacaacagattttgtcacctctcgtactagataattaccaaaaaaatgctaccgaaaaggagataaaacacatctagaacatagtagtatcatgtcatggctttttcaaatctaaaatctgttccctgcagttgtcattttctcttagtcgtcattgatattgttaaaaagttccggaatactattgttaggtcgtattcttaaatgaataagctgtcaaaaaatggagtagtatggcagtaaatttgggaagcacaaaagaaaaaataaaatttcttgatgaatgtgcctttcacgaatgtgacttctcttccataaatcctgtttctcatcaatgagcagcttcttcctccaaagataactgttgaaccctataattgtgacaggtcaaagaagccaatataatgaaaaagatagccagtatctatatttgaaccattttaaggatttcactgaattgcaacgatactgtcttgtttcgtggaccttgcacttcgtagattcatcatgttctatacgtttttcatttccgcattctaaacccaaaagacaagggttacagcgtatgttacgacacaattcaattcaccattcctaagaagttaatattgcaatatttttgcaacaataacaaccgcattgctttgaaagtaattgcaataactatggataaagatccattatcttgactggtgctactttcaaaggaggtatacctaataatataaagctttgaaagaattgacgtgatactaaccttgtacattgattctcattttaacgattttacaaactcacttagcacgcattattgccggaaatacgaataggaacccagcttataatgaacactgtccacatttcttttaggtgagaatgcgatgatggaattgcagcattattaattactagtgtagggtattgaatgtcatttttgtcgattaatatgtacaatacatgttatgcataaaggcacaaagtcataaaaatgttatagaattatatcgaataaacacataagaacgtaagaccaactacagccttccgaacccaaacaatccgccacgcttaggcgtatttttactctcatcttcctttctgaaagatgacggggatctcgatttactcttaaaaaaagagaataaaccaccaccgcctgagcttggtttcaagtgtgctgaagttacgaccggttttttaatacgtttaccagagttcgaatcattagattttacttttctgagcgaagatgagctactgactttcctcaaagatgaatccttattaccagaactcacactatatgactttgaaggtgccaaatggggaaggcctggaacggacaactgatctgtgtcacgatgatggtgatgatgatgttgttgttgctggtcccctgggctgtctagcgagtgcctagatttaatagcacccagtgcagcattaccatctacattcttgacactcgacgcgaacttgatttgcggagaacgtgatctcgacgcactcgcacttgagtttatatcggtagcagtaggagagcttggttttgatttgtctcttatccttgacttagagcttgatcttgacttggatttggatctagatgaacttggattgtccaaaacatcaagcatggacctctgcggggtagccacatgccttggaggagcaccacctgtgatgactcttttcagttcttcaaagcccgactccatagagtgtgctctcttttcgtctacatccccattttcaatactatcagtgatgctatcgatttctaatgaaaactttaatgaagattccaaaataatattcagttttttcaaatgcctctgtcccggtggtattgatgaatcatgatcggcgtcatttaactgctgagccatactctttctacgtttccttgccatggtacataacttttcctttaccgaaatgttagaggttaaggatttcacggacatcacatcattctcatcatccttaaaagcgttaagctcatcatcagatgcttcctctcggctactattgttagcaccattagcttctggggcataacatagtgaatctatagaataatcgttatcttgcttccgtttgatatttgagatagttggaatgctagcatctgctgatttagaatggctgaacccaggctttggaccgctagtatttttttgtttcgttacctccggttctttaaactctttttgcaaatctatttccaaatcgaacattctctttgccggtacaataaacgttggaatcggaaaattagtacacagtttatctgtcagaaagttcgatttccaacgaactaagctgtctgttctctcccacctcaaagtgctagatacaaagaaatcaggtaaatagatgtttattgcctcaagaagcgtttttttagtcttgccaattaggatctcgacagtgaccttgacagaacgatcttgcggaattatgagtgtaacataatcaaaaagatcttgcaatttacgttctatttcgttctgcgtataaccagatgtccactcgataaaattttggtgctttaatttgttgtcagattcctcaggccccagagaaagtgcccttcttgtacatatggatcgtgatctcgatctggatcgtgatcttcttgctgagctaacactcctgctatcatccatcatcattagcattctttttcgctcactcatcgaatcattgtcttcgaaattattcttagtcaggcggggcaggtttgccaacacaacaatgtggtctgtattttgaatcaaagttcgtagcgcccaatctagtgctacccaagtatgtttcctgccgctgatgtggcacaatatcgttcgaggagtgttcgggaacccaaccttttcgctcaaaacacgctctttccgcttttgagacttagtcaaaggcgtaaagccgtcttctatgggaggattgaattttattgtgggagtagcgccctcagacgacttttttttgtttggaggaaacagtattgttgggtaattgaagaaatcgcgcttttgttctaatcgatgatctatctgatttttcttcttgatccatagttgtctccaattgcatacgccctactaatcacaagagcgtcattgatatcggtgggtgtagtaggatagtcttcccttacaattttaccattttcagaaatcttaaacatcttacctattttgatgtttcttttagaggcaggaggtggagaagaatactgccgggactagcactgccctctcgcctactcgaatagctattcccggagaagtagtcggcattgttgtccgaggtaaagccactttcgtcgtcataatattcctccattgtataatctgcagagatctgcacgccaggaaattctcttttctcttcatctaagggcgaagatacccttgatctgggaactgtgttgaaagatacgcatggtaggtacttttcgttgctgcctttccccttctttttgacggaactgctcgagtccaatatcgaggctagactgcgcctgtcatcattgttggacttgtcctcgtcctgcttagcgagtatgtccaccgtatcctccagctggtcctgcctgacatacagcttaacatatttataagaatttctcaacgcctcatcttgatctcgtaccaccatttccccctatgttttagtatcttctgttccttgtactttaaagattccttcccttaaaaatagaagaaagcttctatttgttgatattgctttcgaatagtgagtggactcaagagaagaaaaaaacctttacaaaaattatatgcaaaatatgttggaaaagacaaaagggttttaagttgtgtttactaaaaagtatatagataattctagaggttattgagacatgcagaatgcgtgtgccacaccaccgcaggtgggtcattcggaaattgttcctgttgctgcagcgtctgctgcacttttcgctagaacttttccagtcggatagggagacaaaatgaaaaaaggcctcggactaattaactgacccttcgccaagagtgcgagccttagtatctagacgtctcgcaggaccgtaaccttcgaggagacctagaagaagccactcgggcacgaactcgccaggaacacggtagtacttgagcctagggacgacgaaaatgagcgtctcgagggcgtgagtcaggaactcggcaacaatgatgagtcgcagcacaagatcactatccagccacgcctctaaggtggagcccacaggattagggaccaggaaaaagatagcgtgcagtgcaggacgatagaggtagcacaatggcggtagcgccacgcctaccaggatcaacaagtctactagagtgcaggggtactcaacagtgtcgatctggatgagcgacagcttcctcttctccgcagcgatgcggaacatcttgttgaagatttgcttgattccggtagcagtgcgggtatcgttgcccgtgtcattgtcaatgaagtagataatcttctcgatgttctgacccgtttctgtgtgaaggaacttgagcgtaaacgtggacgtctgcgtgtcgatctctgtcagtctgacatgcttgacggccttggtaatgggaacgtggccaaaaacggcgagacaatcctccagccccaacttgtgcgtatcgttgatgcttacaattaacgaatcccacatacttgtgtatacccgtatacttgcttgagttgatagaacgcacgctctcgccgatataagcctccactctttatatataccatatccaaataggtgtgcactttgtggcaaggagtaattataaacgaacagaatatcccgaccacatggcaagaccaagaaagttcaagactgcgcaagaaacggcagaacagaagctgctcactaacttcaaccttgtaactgaattcgtagggttaaaactccaccacgtttgtagcggagcaatgtcgcctttaagaagtcgctagctatctctttcgcctccgtatagcaatcattgtctaatgcaatccgccatcgttatgtccgcggcttttgtctggagggcaaatcacgataggaagaggcatcttctgtagtaaaggcgtctgtagtaaaaccttttcttggaagccataacaaatcatggccaccaatgcctggcaaaaaagggtggcattgaagggaaatttcaaagatttttttaatagaggccctaggaaaaaacatgtccgtacgtttagatacggttataaactgtacaatcatttgctatcaaatgctgaaccttccccaagggactaaaagctggaaatggcagtgtgctactatttcttttagtcgtatatttaactctcgatcttgcaggctatgatgtcccatatgatgtcccacatgacgcaagtaacttcaaaaaaagaggaattgcgtggcggcgtggatgcaaaaggatgggcgtgatgatgggactcgagacctggttttactcaatgttagtcatatgtatatagtccttataggcccatattagaaagtacatgtcatagttaccctctgcagtttttctcgtagcggaaggggatggaaatttttaacgtaaaagaaagttggtaagagtatggcacatcaacaggtagcgttataggggccaagacatagctttgggcttagtactgtaggcttgttaccagaactttcatttatcgaaatattcttttttcacatttcctcttactgcgcattcgtgtccaaacagtcattcaggaagtataacgataaacaatagattgaagcctgaaaaaaaaaaaaaaagcacgacaatagaaattgtttcagtgtcattggcttttgataatatatagaggctgtttcaataatcatagcgaaagaaatagaagtttttttttgtaacaagttttgctacactcccttaataaagtcaacatgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattgatggtggaacgtaaaagaatgatatggaagttcccttttttttatgtatcgtaacgtatttgcaacatctttataatatccctttgtataaagtaaacaatcttgattaaataaacctgaacataatttattgatgtgaatgttcttttattggcattatttcttcggatgaaaagcaaatttcacgctctatgagaaaaattgaaaacgctattctatgtgaaaatagagatgagtactactagtggctacaataaaaatactgaacctttgacaatcgtacaacaaaaggatcccaaaaatgaataaagaccaggcagaaaaatatcaagaacggagtctgcgacaaaaatacaacctactacatgtactgccaacactgaattccagagcgttatcgggactatactataaaaattttcataattctgtgaagcgatatcaaatcatgctgccagaacaactgaaaagtgggaaattttgctcccattgcgggtgtgtttacgttcctaattttaacgcaagtcttcagttaacgactaataccgagcaaggtgactccgacgaacttggcggcgagagtatggaaggaccaaaaaaatgtatccaggttaattgcttgaattgtgaaaagtctaaattgtttgagtggaaatctgagttcgttgttccaacatttggacaagatgttagtccgatgatcaatagtaccagcagcgggaaggtttcgtacgcggtaaagaagccccaaaagagtaaaactagtactggtaaggagagatccaagaagagaaagttgaactcacttacaaaccttttatcgaaaagaaatcaagagaaaaaaatggaaaagaagaaaagttcgtcactgtcattagaaagttttatgaaaagttgactgtatcatcagtgaacatatagtataacaaatcaagtttatatagttgaattgagagtgtctgttagctcttcgattgacggataagatgcatccgcgtcgatattgttgagattaggaatagtaccgtttatactttcctcatcagcgcggtcatcatcactactgtgagttagaccgccactcattgaacccttcgtcacgccatgtacgccttgcctatatgtttcttccctcaatggattaactacttcctcctcaccaaggtttgaagaaataccagaatccagttttttccgcacgcaactgttggtccacattcgccttctatatgagcccctttgtccatcaagattgaggtcatagacccattttgtttctgaatctatctcgacatactgaataaattcgtcctctacccattcttttggatccaaatcaagcacccaatgagaattggcttcccattcccaatccttaggtggctcaatttcttctaatgacttcactgaattttcctcaatacgcctctggtatattctcaaactagagaaaagagaataatcgtcatcagagaatccaactgggcgccattctttgtattcaggaagatacttttggatctcaaagatcataacaagtcggtgctccctagcctcaatgagtttcaaatgctgcaaaatcttagattccagattagtacttatagtcaaagtttttaatcttgtctcctccgaattcaatttagtcaacaaatattcacgattggacggatgcgaggcaataaaaaaaccccaacctagcagtatcagtacgggtctcattggaatgagcttgataaatttatccatgtacagaaaatttaatgttgctattattaacaatacaataaaataaaacgacgaaatagcctcgttggtgaagaatgcaaacttttgtaatatgagtaaagtaaaatcgtagaatttaacatatagcagcatatggttttgtaaatccgtgaggtttaagacaaattcttggctcagttcagggactggtttaggaacctcaggtcttcgcaaaggtgggccttgtgctggtgtttgattattatctagatagcttgtagggtttggcttatgaatgtaaaggtattgcgggaccattacgcagaataacaaatagaatatagggagcgaagaaagcatttgaaaaggtttcaatataatgagcgtgtataagaacatgatagatactgtatacgctgggttagtccagtttaatatctttattaattcatccataatcatgaatggtacccctagtctcgagttcatctgtataaaattcctactcgtgatctgcacagacagcttaggcctttctttaccagcaaccatacgatggtgaattgtatcaacagccgttttggaagatggtggtaatgccattttgattatcttctctaccagggtatctgccatcatcttttggatgtttgatgtcgagggaaaaccgccaccactagttggctgtccactggaagatggcagactaccacgtgtaggatcactagttctagaaccactagatatgctctctttctttgcctgactttttccatctatgccattttgcactttcttccccttgagagttgatctagttggagtaccagcattataggtgtcattccagaaaaaatttgtcaccgagtccatctagacgtatatacagtaggagactgaaattttgctacgtatacaggtgagtatattcatgcggcctgatcagtaattaaaaatacacactattcctcgttgttatttcttaaaattagttcaagaagaaggggtaacccctaagcttcttaagttcaccacaaaagtattactggatagtgaaacaacaaccacccataacattagtttcctaaacactacggcggtattcacctagacgccatcctagaaggctacaaagtgatgcacgtatgatgatatcggacattagagcgtatacatacaacaggtacacataaaattgtgatatgtcacagcttcatcacccggcggacacgtctattaaattatcaataattacataatgtgcagatcaaataaacaataaacatacagccatttaaattttggttattaatgttatttttcatttctattgcttgcagtggtatttatgtggtatagttaagcctgcaggaatatttaagcaaagagggaaaattatgaataaagaagagcaagaagacccacagcaagagcaaatatcaactgttcaggaaaatgatcccaggaatttgcagcaactgggaatgctgttagtatctccagggcttgatgaagacagattgagtgagaaaatgatttcgaagatcaaaaaatccagggatatcgaaaaaaatcaaaaattgctcatatctaggctgtcgcaaaaagaggaagatcatagtggtaagcctcctaccattacgacttctccagcagagaaaaccgtaccctttaagtcgctgaatcattctttaaagaggaaaagggtacctccagcgctaaatttttccgatatacaagcatcttctcatttgcatggatctaaaagtgctccaccaaacataacaagatttccgcagcacaaaaatagccttagggtcagatatatgggtaggatggctcctacgaatcaagattatcatccttcagtggccaattcatatatgacagcaacctacccttatccatatactggactgccaccagtaccatgctacccatattcttcaactccaacacaaacgcacgcatacgaaggctattattccccgatgtatcccggccccttgtataataatggtataataccagccgactaccatgcaaagaggaagaagttggctggtagatcaccacacttggaagatttgacatcgagaaaaagaacctttgtctccaaacaccacaacggagacccaatcataagtaagactgatgaagacattgaatgctctgtcacgaaaaattcattaagtgagggcgcttcacttaacgacgatgccgatgatgacaacgacaaagaaaggatcattattggagaaatctctctgtatgatgatgttttcaaatttgaagttcgcgacgacaaaaatgactatatgaaagcatgtgaaacaatctggactgaatggcataacttgaagaaatgacgagatttcacttcttcacgctatagaatgcacctaaaactcgcctgcactccgaaacgaaatgcgatacagtacgtgtcatgcggttagtatatatacatatatatatatatatatatattcaaataaattataacgtattaaataatatgtgaaaaaagagggagagttagataggatcagttggtcaactcatggtagtattcgtcataatgttgtacttcactagctatttctgtagcatcaaaatctgatgtgtgtttggtgtccctaatcaaatcagtgacttcgttcaggttcaattctaaaaagttttctaagaactggccaacttccgtattttcgtgattgccttgtaaattgttcaagacatatgaccatgtagctttcttattggcgtatgcatatatgttgacgtcgactgcgctgtgaccatgcgtggtccagccaatttgggccctaaatgataccatgtcattcagtttgtcttggatagcatttgcgttgtcatccaaatgaattaatgtttctaaatcgctatccgtgtaatcgtaaatacccaaatctttttccaggatctcatgtttgatgaaattttctattttgctgcttgcgcccttatgctcatgaacaaaatctactagttttcttttcaaaaactcacctgaatgggtggcgttggcgagcacctgtggataccagacatactgaggatagctagcagtgacttgtcttgaagtgactaaaccacccgtttcatgatccgacgtagagaccaaaacagtctccgtatcggaattttcagcaaactccaaaacgtattggaatgcttcatcgaaagccaacacctcccttacctgcgaagctggatcgttttggtgaccagcatgatcaattctggagccttccaccattaagaaaaacccattagaatctttgtcctcattggaagctttttccaaggcacccaaagccaccttgacttgttccttaagggaaggatactccttttcatctctgtcaatttcaaaaggaatgtcgttatctgcaaagagacccaagaaaggtaaagtaacgttttcaccgtggcttttcaacaaagaatcaaaatttttacggtcacccacgtactgccagccattagattgagcctcatcgattaaatctcttccatcttttctagcaccgtggtgaccatatggagaagccttttcgccttgagggtagaaatggctcctgccgccacccatgagtaagtctactactctccccagaggatattcgcctaactggtgcgtagcgataagatcttcctgccatctgtaatcaacatgtgaactgaatgaagccggagtggcatctgtgattcttgtcgtaacaacaagcccagtgagataacctgctaacttagccgcctcgagcactgtaccacaaggtctgtgatgcggatcaacaccgatggccccattatagctctttaatgcacatgcaaatgcggtggcgcccgcagctgagtcagtgactagtgagtccgaggaccttgttctcgaagacccgataaaatgctcgtcaagtgtcaggatgtcgtctataggtaaatcattaacatgctggttgaatgatcttgccatggacaaagacgcaggtcccatcccatccgtcacgaagaatatgacattcttcttcttgtgtgatgcagaacgtaatgcaaaactgcttggaaatgccagttgcactaaaaccagcaacaaaccaatacagaccacagtggatactattatctttgatctcttcgagatccgtctctttttaggacgagagctcgagtcagatccaggaacaagacgtgtctgttcgcttggtaatgtgtgagtcatcatgctgctaatgcgcgttcaaataatgtcccgtatgctgatatgtaaatgtttatgtagccacttgctggcaaaatgtggagcacgaaaaaatataaacgtttagatacacttctttctttatatactaaaatccctttacttttcctctacgcgcgaagcttatcgctatcgtcaatgctgctattcatgtcgatgctgctcttccgttagacgcgccttacgaggggtgtacaaagaggacatccgctgctgttcttgccactcgttcgtcagttttgccctcaacgcttcacatttcttgtcaatctgctcttccgagagcgtttcttcctcctccagtcggtcccgtagctcgctaacttgtacttcaatctcacgtttctccatatgagtctctatctgtttctgcacagcaagaggcctgcttgccttgtcatggctggcctttttgatcgcattttgtcgttgttgccgctgctgttgactaccctgtggtctgcgcctattgttgctagcaagtgatcgctgcacgtggcccgacgtagatgacccttttgccgacttgagccctattccgttgtacgacatgactggacggtgatgcagtagctgttaaccgtcgaatggtattgtgtagagctcaaattaggattacacagattataataccacacttatagtgccattcttgaggtcttacttgattcttccttgcctttacccgcacgcttaatataatttttccttcttatctgctacgccttcttctagtaggaaaaaaaaaagaaatttggtgaagaaacagtctgaaaaggagataatttgcgatttaattcgtttatacattttatgaatctataatactggaagtgatatccatattcgcaagcagttccactcgaaagcatggccctctttctcagtaagagactgttgagatttaccgtcattgcaggtgcggttattgttctcctcctaacattgaattccaacagtagaactcagcaatatattccgagttccatctccgctgcatttgattttacctcaggatctatatcccctgaacaacaagtcatctctgaggaaaatgatgctaaaaaattagagcaaagtgctctgaattcagaggcaagcgaagactccgaagccatggatgaagaatccaaggctctgaaagctgccgctgaaaaggcagatgccccgatcgacactaaaacaaccatggattatatcactccatcttttgctaacaaagctggtaagccaaaagcttgttacgtcactttggtgagaaacaaggagttgaaaggtttgctaagctccattaaatatgtggaaaacaaaattaacaagaaattcccatatccttgggttttcctaaacgatgaaccttttactgaagaattcaaggaagcagtcaccaaagctgtttcttccgaagttaagtttggtattttgcccaaggaacattggtcatatcctgaatggattaatcaaaccaaggctgctgaaattcgtgcagatgctgccaccaaatacatatacggtggctccgaatcttatagacacatgtgtcgttaccaatctgggtttttctggagacatgaattattagaagagtacgattggtactggcgtgtggaaccagacatcaagttatactgtgatattaattacgacgtttttaagtggatgcaagaaaacgaaaaagtttacggctttaccgtttctattcatgaatatgaagtgacgatcccaacactatggcaaacgtccatggatttcatcaaaaagaaccccgaatacttagatgaaaacaacctgatgagttttctttcgaacgataatggtaaaacatacaatctgtgccatttctggtcaaactttgaaattgcaaacttgaatttgtggaggtcaccagcctacagagagtattttgacactttggatcatcaaggtggatttttctacgaaagatggggcgatgctcccgttcattctattgctgctgctttgtttttgccaaaggataaaatccattatttttcagacattggttaccatcatccaccttatgataactgcccattggacaaggaggtctataacagtaacaactgtgaatgtgaccaaggtaatgatttcactttccaaggttactcttgtggtaaggaatattatgatgctcaagggttggtaaagccaaaaaactggaaaaaattccgtgagtagaaatcttggaacatactgtttctttgttttgactttatactttctatttatattttatttttataactggttaagtacacataggactgcgtatcaaacatataagtgaggcaatccacattttttttaaagattcgaatatttttattctcattagcgtattccgagaatagttcgaaaaaatataaggtatatcaagagtttttacaagtgagaggaaagaggaataagctataagcaacaaaagcgtaaaaaaattagctgaagacatagaactatggatgttctcaaagaggtgttgtcactagaccaagataaatttgaccagctgaaggaaacgagccgagataaaacaaatgaaacggatgatccttttgaaaactatttgaaggattgtaaatttaaagcgccttcaaacaaagatcagtcaccatttgctaaacttaaatcattacaggaaactcattctaacaatgaagcggctattaatataattattcctcaattgattgattacttaaccgaattcactaataggttatcaaattacacacaagatttagacttcattaaaaaaaagtccaatgaattacagtcattgctcgaatacaactccactaaactggcacatatctctcctatggttaatgatttgatgattcctcctgaactcattgatgacatcattaaagggaagatcaatgaaagctggcaggataatataacattcatagcagataaagaagaaatttataacaagtataggtccaataatctcgatcaagacaacaaggacgcagaaaattcagcaatgctagcaccaaaggattttgataagttatgtcaactcctggacatcctaaaaaatgttattctagaaaggtcgaaaagacttattatttccaaaatcaaaactttgaggagtcataacccagtaccatcgcaaaggatacaaaacaaattattaaaagttcaaaaaattttccccttcataagagataataatctctccttagcccttgagttaagacaggcatattgttacacaatgaaatggtattatagagaatacttttctagatatatcaggtcattgactattttgcaatttcaacaaatcgactcgcaatttgcattgggtaatggcctttctacaacttcagtgagtgggtttaacaattcaccatcattgtttttctcaaattatctaactacatccgcttcaaatgctttctataataaactccctgtaacagatgagaaaattgataaatactttcagataaagaaaagattgaacattttaacacaagaagacaatacggtaatggtatcccaaattgcagaaaataacacaacgaaaaactacattgaaattggatttaaaaatttaaaccttgcaattttagataactgtacggtggagtaccattttttaaaagatttcttcgctatgaatggcgataattttgaggaaattaatggtttattggaacaaatatttcaaccaacttttgatgaagccacaacatacactcaacaactgatccaatataattatgacatttttggtgtattaataagtattcgtgtggccaatcaattacaatttgaatcagaaaggagaggaataccgtctatgtttgatagtttcttgaatggtcaattaattcaattatggcctcgatttcagcaattggtcgattttcaatgcgagagcttacgaaaagcggcaataactacaaatgtggcaaaatatgccggcaactcaagcacatccaatagtagccctttgacctcacctcatgagttaactgtacagttcggtaaatttttatcaagcttcttgacgttggcaataacacataagcagtccatagacgaaagatctgaacccttatacaattccatcattagattaagaaatgatttcgaaacagtcatgacaaagtgcagtaaaaagacgaaatcaccagaaagatttctggctacaaattacatgtatttatacaataacctacagcaattgcatctacatttaaatataaatgactcggatgcacaaaactacaattttgattctgctgaaaatgttggtacgaaagttgcgaatgacgacgataatgattcaagcgtaccactaataatcagagagaccgaaaatcatttcaaaactttagttgaagctttcaccagaaattgatgaatgtaacgattgtataagacatggagcgtataaagtatatttttatgtaaaatgatctttatgatttcttattttgtgtggaatatagtcaaatgtttaacgacctaccattatatagtctgtctcaattaaaatccttcaggaacaccttttgcaggtctttgacttaaatcaaggtaaataccgccgtttttgaacccaaaccacttgaatctcacttgatcgtcactatcctcatttgtcgtttcatcacgcttgatatctgaccttccctcctccttagaaataggatcttgaatccgctgaataattttataagcttccacatcagaataaggcacaccagtccttggatcaaagtactgacattctttatttgtgattaaacatttttttcttataccattggctaagaagacacccgttggaggctgtgttttaattttgatttccaaatccttatttatctctgtgttgatttgatggactattttcttatcgtattccccaaaagatgggaaatttgccagagctgacagatcaagtgatatatctacggtaggagacggtactgaagactgaggaggtgatggtaaaatggagtggaaaacagttttcatatcttgtggacgctgagtggcggataacccatttgtgtatgaccatcgatcaccaaataagtttgtgttaaaatcttttagatttggaggagcattaggaaaatcataaagtgtaacaaagttccttgaggttaattgctcaggcccttcgtaggtctgtgttgataaagagttttccgcggaagattcatcaacattagctgtatctttttttgagggtgactcttcagtatcgattatggccacttgcggatggtcggtaaacgttacttgtttcaagaaagaaacatcagtattgcttttggtctcttgtggtacattatgagataagttctcgatgccttcggttttcagacaaggttcaggctctccttttatatccgtatccggagagatcaatatagtatcttcagtgccagtggagtttgatggtgtaggtgttgcagaattatccctttgtgagaccacttgggcagcaggtgatgagttttcaaaagtattttccctgctctcgagagcacttaccatttcatctttaatttcttcattatgtaaattttgtatcggttcgcctacattggtaattttttgctcattagttattatattcttttgtggttggctgttgggagcttcatcaacggtactctgcttgtttgcaattgcgtccaatgtaacatcaggtaatgctgttggctttaattcgtctgaatttactctactcaccgctgcatctggactcgattctccttcaactgtatcgttagtagaagtttcctcaatccttttctggttgtgtacagatgaagaattctcacccaaagaattcacgtcgccatcgttctttatcgattcttcactctcccgctttttatcatctgatgcgtcctgttttccgagatttaaattcttctttggcttcctcggatattttttcttcttcttatcacgtttattcaattgttcctgccaatatttacgatcttctaactccatcgctggcgtcattagccaagcagtagataaaaattgcagtatagtctcatttggctggaatttctgcttttgtcttttctgcaaagctagacgattctcctttttccaaacttcttgttccttgaacttatccagtgacaaaatattcagcttctcagtctccttggcaatccgtagcctctcttcttgtgtcagcatatgctgagactcctgctccttgtgtttccttattctttcttgtataatttttctctttttttcagctttagacaatttctcataaactttcatcgtgttttccattaccgatgatcttttagaagttctccttgtatttaatagtaacgtctctgcgtttaattgttcatgggtatggtgcgatcttggtatagcttctcctgacttaggcttaggtttttgttttttgattacaacgggacccttctgtaatctcttgtttcttttctttcttgaaagtagttcttgtcttcgtatttccttttcctctgcatcttcatcattctcgttgctggagtcctcagattcgctactgctgaacattaagtcatcggctgcttgctcacttgaagcctgagagggctctttccttatactttgagtctcatcttctttttcttccccttcatcatcgtcatcttttgccatcatttcgaaatcttcatcatcttcatcttcctgaaacaacagccctatttcatcttcttcatcatcattaccattcttataggaagaaatttgtcttttggtagattctatatctcttagctcctgctccaatagtttttgtaatttattaccggcattagacctcctagatcgtgtttgtataataaattctgtgttagtatctagacttttatcagcaccttcatcactcatcgtgcactgtgaatttgcttcggtttcacttctatttgtattcattagactacatggtgctttctgcttactgttttttccatcaggatttttttaacaaagaaaaaagaaaactactaaaacctaaataaggtacatattttggcttaccagcaaagagaatataaagaaaagggaaaggagagaaaaattctgaatatgcaactttgtgtgctttttgttttcactgagcgctttctaaagctttatttttgtcttcagtatctaagtttggctcttcatcaataaaagccggtggcgcattcgcacctagtaagtaactgggcatatcgttacctaatgagttttcgctggttggcaaagtgaaatcctcttgtgccagagcatccagctctgcatccagctctgcatcactaatgtcgtcgagctcgccactgttattattcattgccaagacttcttgcagctcatccccttgttctattaaatccagcatctcatcctgcatgtcctgtagtttgtcgatatttatcttgccgtattgagccttcatggcattgtttgtttgctttagtgcgtttatagtgatcattgtgttctgtaagttatcatttgttaactgggcttgcgtcatggaccaggattgagaatctaaagaatccttcatattttctaactgtttacgtttatttaaaatcttcaaagcctgttttcttaacgagggttgcttgttgtttgatctttgcaaattcttttgaatattttgcagctggaagtttaactgggcgatttgagtatctaactgggatattctgttcgatagtgattgttgggcctgattcatggactgattcgactcttgtaagagctgatcatggctctttttgttcccatatccgaaaatcctgttcataattgccttgaagagtttataactgtgtttcaaccaatcttggcttcctcctattactactttttttagatgtactttttctcttgctaaaaatcccatatttttgtatggctgaaaaacatagaggaagaaaaaggtcaaaaaacaaaagatatatacaaagttacaaatatatacatgtatatatgtgtgagtctgttgtgatagaatgaatggagaaaatgttcaccagattatttcttcaaatattgggccaattcttcgatggagatcaaaggaatgccatgtttcttaccaaacgcttggcagtcatttaatctcatcatagttccttgttcgtcatcgttaaccaattcgccaataacagcgacgggacttagtccacttagtttacacaaatcgacaccggcctcagtgtggcctcttctctgcaaaacaccgccatcagcggctctcaagggacagatgtgccctggttttaaaaatgattttggcgtagaggaagagtctgcaagagccctacaagtcatcgacctgtcgtgagcagaaatacctgtggtagtgccttgggctacatctacagttattgtgtatgcagttccatgcctgtcgtcatcattggattcaaacttcatgcctgttctcagtagtggaaggtccaacttatcagcaatggcattcgtcataggtgcacagacgtagcctgaggaatggcgtacaagaaaggccatttgttcagtgctgacattttcagcagcgcaaataagatcaccttcattttcacgaccggcatcgtccataacaattacaaacttattctgcttgaagtgttctatagcttgatcaattggtgtaaacattttcgacgttgccttttcttcttttcctttccttttttttagccttctgctttttgttggagatatttacattcacctcacatatatacgccaatgaaaatttcacaatagcacgtatattaataatagccttgcttttttttatcaattctcgctaagaaattactcatcaggcaataacctatgctcacccgcctcgaagcggcgttaggagataacagtggccgtgtagagggacgtcttagcatcgaaagcccaatttacaacaacgaggcgaccatctgcacaccacacttgacaccgtagagtgcgactattttcccctccattgtttttttcgagccagcgtgcacgtagtacgggcccccctaacaacaatggcgcccctatgatagctttccctgctcgcgcgtcccacagccgcaccgtccagtccgtggaacatgataatagaagcattagccgccgagcatcgtcccaatgaaactctaacccggttaccctcgtagagtggttttctgcaggttggaacccattgttgtccaaagagaggtacagcggcccaggttggtcccagaaaaccttgtatataccaccgtcttcgccaccgatccagacgtactgcgggtcctcactcgtgtacgccatgcaagctatacctacctcatcaaactttgccaaccgctgcaatcgctccgtatatgtgcaagtatcattctccaaagataaaagctgtgatagcggtacaggacggagctgctgtggcttccgcaaaacagtcaagtccaggcagctcaactccataatattgccattatcagctgccacaagtactctctcttgatcttgcacgctgcttgtttcaattacagccaccactgggtgctgaaagtagtgtcttgccaccatatttcgctgcacgacatacactaccggtgtttctggctttttctgtttcaatctaagctcgtacaatatgatcttgcccgtcaaggtcgccaacaagattgatattacattgctttccggatgataccgacggaggatcgtggctgtcatgatccgcgtaccacggaactctaccatatctatcaagaggccgttgcgtccgctggcattatcgcacttgactacattcaccacagaccacgccgcttcgctgctagcatactgtaggtctgccggcggcaatcgtagataaaccacaaccaagacgccttttcctgggtcatactcctgagcgatacaatcgcagtctgtctctgattgtaaattctcactgaccatgttccattgcatgaggttgtctttatcctgttgcatgttcgatggcgcctgctggcctgacgcagaaacctctgtctccagccgcgcaaaactagcgttgctcagcgttgccgccgcctcttcaacaagaaaaggtttggctagttctaaccttggctggtcgttttcagctttgtctttattattttcgtcggcagcagtagtttcaatggcgacagcatcagtagtggtgtgattttcattttcttgcagttgttcttcctcaatttgatctgtttgaatgcctttgtcgtatgttataacctccttacgtcgaagatatgcagattggggctcttgaatctttgagccttcctccatgtcggtctgcactgaaacgctgaccatggttgccttagcgtgcacctctgtgggatggtggcccatcgtctcgctcccagggaacaagctggcttgttttcgcctctcacgcagctctttcaattgtctccttttttcctccagttgcttcaatcgctccatcttaatgtttcaatccttcttcctctttggttgattaaccaactgtgatgctcttttttcccttttctctttgtttacggcaaaacacgaaaactagttcatttctttttcttttcgccttggactagtactgaaaatttcaatagcattatatttgagccataggtaagaaaaaccaaatttgttagtattgggaaggagaataagatacctgactcggtgatggacattaacatagacgatattcttgcagaactggataaggaaactactgctgtcgactctaccaagatcacgcaaggttcttcttccactacccacagagatgcaaatacaatagtgggttcgtccttagacttgaatgacaagactcagatatatgtctctccccagcaggatttttctgacttgatgaagtcttggaaaaatgaacggtgttcgccagaactcttaccatatcctcatcagttgatgaaaagattattgaatcgaatatccatgcaatctcaattaattgaaaacatttcaatgggattcctcgatatgcaaaatgcttctaatgcgaacccgcctatgcctaacgaatctaaattgcctttactctgcatggaaactgagttagaaagattgaaatttgttattagaagctacatacgatgtaggctaagcaaaattgacaaattctcactttatttgcgccaattaaatgaagatgaaaattcgctgatctctcttacagatttactatccaaagatgaaatcaaataccatgacacgcattccctgatctggttgaaactagtcaatgattctatcctgaaatacatgcccgaagaacttcaggctattaatgatacagaaggtagcgtaaacatgatagatgagcccgactggaacaaatttgtctttatacacgttaacggcccaccagatggtaaatggaacgaagatccgctattgcaggaaaacgagttcggtaaaccttgctacacggtcacaatacccgatttaaaggaagaggttgaactcactattggaagtatttacgttatgagatatgaagtcattagggatctgctgagagacgacaaagttgctcttatttgaactattatgcattacactttccccttcaccatgtcttacatatgcatatatatatattatcaagcacagtttcatttttcatctgtccgtgtcatgtttttccgcatttgtgtcgatcttgccagcaattttgagtaattagatgacgatcgggtctgcaacgaagtgggacgttttgtgtgaagtgcgccttcttcgggtgtctttaagatgcaacggtccggtaaaccatttattagcctattcgattgaggtacgggaggagcttgattctttttttttgtattctgtcttttttgaagaatgaacttatcaaacattttatggtccgacttcggcgatactactttaggtttggcggtcattccattatgtattaatttccatagtttcattaaaactgctctctctttgcatcctatgaaaatcgtcctggaaccgtcaatttcaaggacttgatcacttataaagcgtatcttctcaacgtcattcaactctagttcgaattgcaattcaaattcctgttcttcccacatgctgagacttcttctcttgacaaaaacaagtgctctgcctaggtttgttattagaaacattttcttgtaaaatttgcctgcactatcagtaggaggctcgatatcaagagggttcttgtagtccagagccacgttctcaagacctacaggtgagtcctctaagtttcgtgtggaaagcgctacctccttcatcaacaagacacgttcatccatattttgcaagtagcgtgaccagaaggcgtcagaagagcgacttctattatctttcccccgtgatgtagtagaaattgaaggagatgatacagatgcgcgattttttgaaaccttcttttgaattacctcgcgatctgtgttgttggaggcagatctaacagatgtgcttgacttgctccccaatttgggttgacttgtataatctttattgaatgcggcggttgctgcagtcatactgatcacagaatgctcttgagaggtcgctgctggtgcttgcaggggagtatctgcatgtccattaccagccagctgaaggttggccattttgacagtggtatcagattcagaaaccttttgcaggggcttcatcgcctctgcatttattttatatggctgtatctccggtggattatcatcccaaacagaaccatcttcaaagttgacttcatggaaaaagaggtgtgctttgatctgctttatggtcaatctatcatttggatccctaactaatagttttttaactaaatcttttactatttgcggaaaacctgcagtaaacgcatattgaatcttcattactttttggaatgtcaaatattcattggcagctttaaaaggcggttttcccgcaagcatttggtacaatatgcaaccaaatgcccaaatgtcacaacgggaatctgtataattatcattcagtagctcaggagaaacatattctgcggtaccaacaaatgatttcgacttagcatacaaatcgaaataaggcttgccatctgcggtgttcgaaggttcctccggtaaaattttggctgtaccaaaatccgtcaacttcactttcatatttttgtcgagcaatatgttttcgggcttgatatccctgtgaataatgccgatattatgcaaggagtcaacggcatcgatgatctgcgacgcataatagcgtgcacatgtctcgtttaaagatccatatttcttaatcaagcccaagaaatcaccgtggggggcatattctagaaggaaatacaagcttgcctcgtcctggaaagtgaagaaaagcttgaatatgcccttggtgccattcagcttctgcaaagccaatttctccactgtgacgtatttaacttttttttgacggatcagatattctttactcaacacttttactgcatatttcttgcccgaatcacgggcggtagccagaacaacactagaatatgatccatccccgagttgctctccaaacttgaagtcctttattcccatcttgacaacatgcttagttaactcccccgtagctgggtcgacaacatctttgacgatttttgccgcaccacgttctgcccattcttctcttctacgcctcattgagggatcaagacccatctcgtgctgcatacccgggtcatcatttgccaggggaatgaagcgattagtactagtcaatgccttttctccaaactgaccttgtggagaagcctgtagttcagacccgctctgagaattgctgccatctacgaaaggacgaggatactcttgcgtttgtgtatgttccgcagatgtcggtaccaagggcttggacagcagggcgtggtctgcctctgtcaaagacctatttcccatattaatgatatagtagcagtattcaagcaagtacacgtgcgcaagttgtaccagatagtgactgtccagcgttactttctcgcctgctctgtattactcttgttgtcactccgcaatatctcaaagccattaatatgtactaacttgaatttttcatgctcccttaaacgaaaataaccctactgagattttcacctttatagggttatatgctaaaataagtaggtcttatcatgcaacctttagggtccaagcccttaaatccgacagtcgggcaagcccattttcccaacgatttttcaacggtttttttgcctgcagggcatcggcaatttgacaatactcacgaccgatggatgcagcaatcaacgtaaaaaccttacttagccggttactcatgtatatgtcagacatatatacacacgcacacatatatatatacgtacatgttggcacccttctgttaatagaatttgatttcttttctaaaggcatatcagtatcatcagttgaaacagtaaggagctccgcaagcgcaatattaactttacaaaagtgattctggttcctaacttttctattgttttccattttcgtcattcgttttgttattagtcgccttaattgagtcaagcaagataaaagaagaaaaaaaatgagtatcaccactactagaagaagaaaccaagatagtgtctgctgcaaggcaacgagagcctccattaaggtggaagctgtctcaggccagacagtttttgaaaagcaaaaactgctacacaatttcgatgagttgccagaatggcaaaaagataatgacaaaattctcaccgggtacgttcgtgaaacactgtcatggaaaaagtgcttatattctttattttattggaacaacgagactgtgaacatttatacacatttggtaccggctatcgtatacttcgtgtttgccattacgttgaccaactactttctaattcccgttttcccctccacttcctggtccgattacaccgttataaacattttcttgatgggcgctttctcatgtctcatgtgcagtagctgtttccactgcatgaagcaacactctgaaaagcaaagcaatttctggagcaagctcgactacttggggattatcagtttgatttcctgttctatgatccctataatatactttggttacttcgaccacatatcctacttcagtcttttcacgattgttactttagtcctggcaacattttgtacagtctgtgtcctccacgacaagtttaacacttccacatttcgtccatttagggccatgtttttcatattgtttggatttagtggcttactcccattgaccacagggtttttcaagttcggtatccaaggggttcttaacagaataaaagtcagctttgtgttttgggaagctctcttttacatttcaggggctgtaatctacgggtttaggattcctgaaactttggctccagggaagttcgatttcttcggtagctctcatcaaatatttcatattatggtggttcttggttctgtatgccacttgaaagccattatcgattcttacaaattaatgcattctcatatccacccttgatgggcctacaactactacaaaatcaaataaataacattatatatctaaggttagaaaataattaaatgcaaaaaaagtctttattcctttttagatattcgtcacatcatgcttttatcatagatcgcattttgacaggtacttcgctatattagcctaattaattttggtcttactaaagtgagtaatgccgaaaaattaaacgtttgaataagtgaacctactacaaaggaaagagaggaagagaaaaggataggactaaaagacttccttatatttttcggtacgcttgcgtttcactgaagagaataaaaagaacaaattatataaatttaacacactatgagcacgagaacaaaggccctgaatgcatacaggcatggcttaagagcaacccgaatagctttccggaatgatgctgaagtattactagccgcgagagctaaaatgcgttcaggaatgttatgtcccccagatcctaaactcaccacagaggatcagattcaacatttagaggatgtggctgtttttttgagacgaaacctggttcagggcaaaaaggttgatggctcaagtactaaggagcctaggtaccatttgaacattcacaaagacaccgaattgggtgacaatgagacgattgcagaccctacggcaagagtgaaaacaaacttaaaggcaagaccatttaaatgctctgataaaaagcaatgataatgccttgattttgttttatcttcgaagctatatacatgtaaatacttttttagtacctagcaactttgctaggtggcatataaactgatttagcacgatatatcgttgcatttgttctgtttgtagtatgtacatgtatacagcttgttgtatttgatgtgctactgaaacagcgtagttgctagtgctttatcccttttgacggaaatgaacaaagctttatagcggaattaaacttaacgaaactggagaaagcataaaagaggaaaagggcagcggtaactcattaaataatctagttggacgagccataataagagaaatagacggagtagaaaatgcgctcctccatgtttagatgtgtgagtcgcgctcattacagcacaagtgtcacagaagatttcataaatagcattctagcaagggctcaagaggcaacagcaaaagcttcctccaatgctctcaaattggacaagatgaaggagggtagaatgcaaaataagaggagaaacgggaatcagaataggaatagtatgaacaataaagaaagcaggggtagagagggaaatcaaggagaaagaaacatgagactgaaaaaccgttctagtgattctgttcgtgctaacaagcagcagtggaataaaggtgctaatacgtcttttgtaaagaatcctactggaaatacagtagttatgcagccacagttcaaaaagatgcagaatggcaaaaataatttgaaaggagatgcgagagtcgaagatgatttacttgatgtcttcaattcgtcgatggagcaaaaacctgttaatttcaatggaacccccaaatctaaagcaaggtttcaaaaaaagagtcatatcttaacagcatctaaaaggagaaaggctcctcaacagcagctacagaaggttatcaagagacctgtcagttcagaatatgtactagaagagcccactcctttatctttgttagaatatactcctcaagtttttccaacaaaggaatccagattagtcaactttaccttagatagcttgaaaaaatccaattaccccatttacagatcgccaaatttgggaatcctcaaagtacatgatttcaccctaaacacgccaaactttggtaaatatacaccaggatcctccttgattttgatcctccttgatttttgccaaagagcctcaattgcagaatttacttattgaagaagacccagaagattttcataggcaagtaacaggagaatatcaactcttaaaaccatatgtgaaaaaagattttgaaaaactgacgaaatctaaagatactgtgagtaagctcgtacaaaatagtcaagttgtgaggttatcattacaatctgttgttatgggctccgaggaaaagaaattggtatatgatgtttgttctggaatgaaaccaatttctgaattacaacagtaaatcaaacatcgttatttcattcttacatacctgtaaatatctagtacgtataaaatttgaattgtatgcctgaacagaaaaagaataggtgggctcttcttatccttgactatcaaaattccggcttagttcgtcagaaatggatatttgatttttcaacaaacatttccgcaaattagattcctccttcttttcttgatacttaataagtacctttaaaagcaattcggatattgtttgtacgggaaatacggaaggtatagtttcgaggatctttaattgaatatctgtatcatctaaaagttcaaaatttctctgtagcaaattagtcactaattcaactgagtaattcaaagaagatatgtccaagtattgtttcatcaccgcaaccaagttctgcttgcctatgtatttttctacacttctgaaatcattaaatgacaaatatattttcagcaattcttcggaagaaacccagtttgttaattcattggggaaaaataacaaggtcaatatgtgttctttatcgatcttggaaatttcgtcgaaggtgaaattaataaactcatcatctttttcattttccgatttcaagttttcacatttttcataatatttggaaaaattttcgcactgaagactatgctttaatttgatatgaataaaatttgttatatctgtcttatcatacgcgaaatcgtctttgtactctttgataaaatctccaagaatggaccatatgttactttggttgattatttctcgcaatttcgccaaataatagttaaagagaaatttggaatcgttgctgttttggacaccgagttgttctatgaatgataccttcagggatgtttcttctgcgggtattttgtttaaaaagtcgtttttattaatacatgccatgtccaatattttaagaacctttttgatggcgcattcctcagtattttcgtcgccttgtttaagagtgaggagaagatcatcggctattctttctttgatataatcctcaggaagttttttgagattttcttcaatgaatgaaactagtgaaatgtaatccccagcttccctcaaaagatttagtgctttaagatattcccctttttctttatatatctcaattagtaactctatcctaggaagtttatcatcatgtaaattaatctctctgataatttcgtcgtaactttcgcgttcaaacatatcaacagttatagtttcctttttttccaatcttaatttgaataaagttatatcaatagttttcattatatcatcaaagtcattcgttaagagtccagttttattctttttctttagttcattcttcatcatcagaagcatttttagaatattctcgcatttgttagttagcttcaagcttttcaacctttcaactatatttattaacccatggaagcaccagatctcgctatagactttccagccaaacatataaaataatattctgatgtcaactttgtcagaaaagtcacaccactttttcattacctcatcttctatgtgatcgtaatgtaaggtcattagaaacaataaaagagacatcaaatatttcgcttcaatgtgctcaaattttgttaaatccttcttcgcaagctttttcaattgatcttcaatattatcaatttcggactcttcacatgatgtaaaacgtaagaccatcggcgttggaactaataaatgaatccctaaattattataaacgattaaagaggtcttttcttcataagactcttcaacaaaggcgcgttctctttcaattctaaatttattatcactatgtgtcagaggctcaagtctcaacttattgaatattttttctttgaattcttcagaattattggtattagtgaatacattgtcagattttgaaatttttaaatccgatccagaagtagttatactttgcaacaactgggatttttcactcggcaaggcagaatatatgtcaaccgactggaaagcagactcagcgattatgtagggaaactcaacaattacatttcttggataattttttagcactatagttccttttattatgtcgccatgatgatttaccactaaggccatcgccccactatcgtatgatcctcctccagaacaaactaaaaattcactctgttcattgaaactggttattataggttctaagtcttcgtcagtctcacttattcgaaataatggaattacctgtgacgactttagatttataagttcgtaactatttaacttcgaaaccattaatgtttcttcgtgcgcacaagctttatctattagtttgaaattaaaagctttggtaagtactaatgaatctgcagatattttgagtagtcttacgccttctgcgtgaaatgcatatattctataagccttcgagcttcgggaaaaattacaaataacgacatcactaatacctttaagtctagttgtgttgggccttggtgcaaattctgggagaataaataaaactagttcgttatcacataatattagtgcgccttctactttaggtaaaagaaggattttgtctatcttcgaatttgattctgcatcaaactttgtttgcgacacaagcatatagtttccacgttcaagttcaaagtaatgtaaaagatcacctgtagttgttcccaagaatatgtggttctcatacgcctcacaacatgtgtatatcaagtcagatggtacattgtctaatagggtagagattgtaaaaggaccttcgcttattttcagtggcaaccctttttcctgttcatcattcgtggaggttttttcatttaagcttgtaatatctgtatttatgacattatcttctgcgctgctaggctgacagctttcttgtgctgtgtttttatcagtatgtggactgtcttcgattggtcgactctcttcctgggaaaatttatcagctcgtactgtttcatttgggttagcattatgtgtattcgtctcttcactttctgttgcacgtagactatcatcttctgttttttttttgtcattttctctttcgtgaggtgaggattcgctatctatatcgagctttccttcattttcctttacttcttttcctttgtcattattcgttttcttttttaccatggttctataatattatggttgcaaccaaaaaaaggtagtctccttgactgttatgatagttctgattcactaatgtcgttataaaatagtaagtacatatgaatatttccagttaaacttgcctttttttcccatcggaacggtatcttcaacagatattatgcgatgtaaggagtttttaggagacaattatatatacctgcactttcaatgagatcaagctttttattattattgtacagatgcttatataccaaatattgtgactttatcgtagaaaatttattttaacaatttagccaaaagctgagagcctttgttactttcatcagtggtgattttactctgaactcctctcaaatccttcaaaaatggtttcccttctttttgatcttttaacgtttcatacagtgcaacaattgtaaatgaactatcagcgttattaatccattctaacaagttggaggagtcaataatttcatcgtataacttttcagcaaatggaacgcctaagccttgaacattttttaatggtatgacctttttttctttgttattccatttaccaccttgaattagtgcctttaatagtctagtagaaaatgctctatgtattgggtgctcttcttcggttatgtcacccttaaaagtagttaaaatgttgtttaagacctgttgatacttttcttggtctttttcattcagctgcgcgtacaactcatcgtttattagaacttcggcaatgaactgacagcctagattctctgtcaatatactggaataatcttttgatatagtgcttaaaaacatgggggcgaattttgacaaaagttcgtgccttctttgtaaaggatccttcttagaggtggctttggacagttcaatgtatctcaataattcattcttgacgataggtgagaaatacttaccgtccaaacctaatagtatgtataaccaaggccttctaccaaacttatcaattatgaattcttgcaaatgttccttaacagtaggactgaaagtcttgaatactaaaactgtatcgtcaacacagttcagaattgtaatgaagacaatattaccgtactcatttttgatcaatttttcggcgtggtttttcaaagcctttaaaattaactttctttccttggcgttagctctagcaaccaaagtacaagcaacgtctgaaccttctggagtatgcaccaattcagcgaattgttcatgaagcaattcgatcatttcagatatttccttttcgttggctattttcacatattctctcatagcagcatgtagaatttgaaagccggtggaacccttttctactgatgcggtaatggtaccaatcaagtttctggcgataatattccttttttcaatgctactttcacaaactttctcaatggtcaaatctttgtgggtttctctaaatacagcatattcagagccccaaaactctttaatcatttgttgtctttgttcatgtgtggcataaagaacaaataaatcttcaacaacgtaggcaccctcacgatgtctcattaattttctcaaagaaccgtgtaattcatttattatagtttgccttgaacttcttgaaccataatgcagtaacttaaccaatagatacttaccgtacgcagatgtggctagaacataaaattttccctttaaagcatcgacaatttgttcacgacgatctttggacgaatacttgactaaagtttgaacaatacgggaagcatcatgctttaagacaagatcactgatacagtccttagatagctcccagatttcgttggaaagtttttcacgaatctgttttggtaaaggtggggtcttcacacgcaatctttcccagacggatttaatttgttgcacttgggtaccagattttctttgcattttcctttcttttagcagttttctttgttcagtgtgatttccattttcacctccttcagatttgtcctttccttctttctcttcattctcattttcatgttcctcactgtcatcggaaatatctaattcgtcagcttcttcttctgcttcagagtcactggtacttaaatcatccaaatcatcatcatctgatgaagaggatacagcatcttcctttttggatagttctgattcttcatcagacgaatcaatagaaattctaggttttttggctaatttcttttctgaatgactaacttctttagcagaacgttttccgtttgtcttcttggttaaaggtgccattgtcagttaatttgttattcctgattgtgctttatttcagtactctataataaaacgctttcaccttcgaaatactttaggtaggcatctcatctcatcccagcaaaaaaaattttcagtatttctctcaaggtgaaaaaaaaaaaaggtcttcaatgccgggttagttaatcttctatatatgcatacaacaattagttcgacttaaatacaatgaacttttttctatcttgtaatttatttttatttattttctactatgtatttgaatattcaattgcgtctccttccttttacctcgtgaaaggactatatatcctctataatctcttgagttggttcatatttcaattcatgaactctggcaacttgctgttttctcttcttggccaaagctttcgaggctttgatgttgaacccgtccttcaaaatagtttgtacctcttctaactccaatcccgataattctggataacagaagtagcagaaaatggttgataagcacgacaatcccgcgaaaaaggcaaatgtacctgcaggagtgatattctgtaacatggtcaaaaatgtggatgcaataaccagtgaaccagcccagtttgtagcagttgcatatgaagtcccaatacctctcacgttttgggggaatagttccgattgttgccatggaacagtaccgataccaagagcgtagaacgcagcaaatacgataataaatacgatgatcacaataccccaagaggagaaaccggaggaaaccaccacagcgacagcgccatcaaacttaatacctagaaaatggaaagcaatagagcacacgactaaagccatggtcatgcctggtaatccaatcaataatatggttctacggcctattttgtcaatggaaaaaaaggcaactaaagtgaaaataaaattggtaccggacacgatgattgaaacagcggaagaatttttgaaaccgacagtttcgaagatggtaccagagaaatacatcaacgaattccaaccggtaaactgttgaattgcttgtaaaccacaaccaatgatcaaagcccttagattagatggtactgtgtgcaattctttgatggtattccagactttttcagggacattcttaccaggaatagattgattcaaagtaacaagttcttccaccttacgttcaatgatttcctccgaagtgtcagtgtaacttctcttcaacacctcagtagcccttgccaagtcgcccttcataacgtagtatcttggagtgtcaggtaaaaagcacaggcatgtgaattgcacagcagtgggaattagtgacaatccaacaagaattctccaaccattgttgacgtagtttaacccagcaccgcaaccgtaagcgactaattgaccaccagtcaaccataaggaattgatgacagttagtctccctctgatcattttgggagcaatttcactgatgaaaagtggcgcgatcaaggagccgataccgacaccgaaacccatgatcagtctaccaacagccatttgccagaatgtgtgtgcggagacctgtaagattgcgccaatgacaaacatcagattcgaacccattaaacaacgtttcctaccaaatatgtcagctgcagtaccggcgaaaatactggtaatcaaagctcccagagaggtagccgcagtgacaatttccttctccccataagtaagtaccttgtggtccagatctgtgccgatcgagatcagcgcactggatatataaccagtgtcgtaaccaaacatgaaaccggatatggatgcgacaaaagtcagagtgatgatgaagggcgaaagagattggttaaaagtgatcatgaccgacgtgtcatcctcgtcgttcacgggtttaatttgaatcctatcttcatcatcgctagcgggagccctctgtatttcatgtgactcaagtgtaattttacctctctttgaaggtgagtcatgctcactgttgaactctacactatcagcgttgccaacggcatcaccaacatttgattgcgatgtctttgacgtgagatatggtatgtgtattcccattttaacacccactgcagaaacaaagaaaatgaaagagatgtatacagtaggacgaccaataaatctgaatagcgcaccaaactgaaagagaagaatagagcaaacacctgccaaagaaaagcccaagtgtgaaaggtcttttctcaactatggcttgattccttttatattttttccattttgcaacagcgcgttgagcttggtcgagcttttttcacatgcggtggggaaggcgtatttagcgcaaccagtggggggtataagctatacctaacgcatgtgaagagaacagaaacaatggtgagagaaaataaatggagaggatggagagaactaagtatatgcgcttattatgttatatagatgttaaaattatcatagctcatcatgtgagacgatcctgtccacggcctcatcgacagcccgctggatactactgacggctgatacagatgcgaatggttccacagaggttgctgaggatgtagttgtagtggctagaatgggtgcatttagcacaagactgggtgcttgaagagaggacgaggagcctgcatagcttttaactagacctagggtgacgagtatacccttgaaaaacttgaatagcagccagaggccgagtttaacaggtaacttgaaaatacgacgccatagaacccacgagacgcagcataggaggaacccaagtgataaatagacatctcgtttctcttgatgggaggcattttccagtactttgaccaaatcggcagttttcttgaagacggtttcgaattgagtgtacttgtcatcgatttgtgttaaggaattggtttgggctctcaattcatccaaattcaggtcactttgtaaaattccggactgcaaaatttgatttcctctcaccaagttattcgtcagttgttttgttttgctcaaaagcttctctctagtgctggctttttccatcgatgtggacgttaagcttgacgatgacgacgttccttggtgaagcttgtcgtaatccacagcgtgaaattttatagcgcggtctcttttctcgtcgttccaagctaagtcacgtttgtggtgttgtcgtagaatctctttgactttcaggcggtagcaatagaaccaatcgacgaattgcaacacgaaatccagttcttcgaccaactgagcatatatgtcctcgttcatttgtttatcaagcttcacaatatgcaacttatcgcattgatcgtatctagggcttttttcccactgtaattttaattcggggtatttgtaggtcatttccacaatactacatttcagtaccgattcgaaatctgaaactttgctctctataatattcaccaaatcctcaaattcaatctcttcttcttcatcattgtgttcgttggcaatggctgcaaaactgtccttattatcatgcttgctttctccgctttcttttctgcgggagattgcacttaatttttgcaaattatttaataatgcatcttgcaaaacttccaggtcctgcaaaaatgtcacgaccataatctttaatggctttatagtttgttatgcgccttggcagcgtgatccgatcttacttgttaactgtatatcaggtatttctgttggcatttttacaactgcgaatgtatttttcattatttagtaacaattctatttacccggacagcgtgtgcaggtgatttattgataaagtcactggtaaagacgtgctttctttagtgtgggattagatttaccacttgttttgagattaggaaaattccaacgtttgctaaaggtgcaaacgaagctgttttgttgcttttcttttctttatgtaattgtatttaccatgatcctctttggtgcggcgctaacaatagaaaaaaatacacacacattagattggaattagagcttaagtggtacaaactagggctaataaagaggtaacggtcggttctctactaaggttcgtattgtgtggcaccgatgttaagcacttttaagcggaataactcgagtggaaattttatgtttagttaggttttaccttgaatttttttaaaaaaaaaagagtcagacaggctcgctctttcctactaaatattaggagcaaagcagtaaaaagtctctgaataaggatagtaacctgtagtaactccaaaatttatcttacaaagagctattagtatcttggttcttctattttcttcgattattggtgatttttcccgcctctagccaaatccgagcgttccatcgattttttggggaaaacagcacatgcaataaaataaaaagcaaacaaatacgcgatagtgcacgaaacgtcaacacaatcatcaaactcttttgcatatttctattatagatgagacgagaaacggtgggtgaattttcttcagatgacgatgatgatattcttttggaattaggcaccaggcctccaaggtttactcaaataccgccatcatcagcagcattacaaacacaaattcccactactttggaggttacaacgaccacattaaacaataaacagagtaaaaatgataaccaactggttaaccaactgaataaagctcaaggtgaagcaagcatgcttcgtgataaaataaactttttgaacattgaaagggaaaaggaaaagaatattcaagccgtcaaagttaatgaattgcaagtcaagcatcttcaagagttggctaaattaaaacaagaattacagaaactggaagatgagaagaagttcttacagatggaagcgagaggaaaatcgaaaagggaagttattacgaatgtaaaaccaccgtcaacaacattatcaacaaacacaaacactataacgccagattcgtcctcagttgcaatcgaagcaaaacctcaatcaccacaatcaaaaaaacgtaagataagtgataatttactgaaaaaaaatatggttcccctaaacccaaataggattattcccgatgaaacgagtttatttctagagtcaatattacttcatcaaataataggcgctgacctgagcacaatagaaatattaaatagattgaagcttgactacatcacagagtttaaatttaagaatttcgtcattgctaaaggagcccccatagggaagtccatagtttctctacttttgcgatgtaaaaagacgttgaccctcgacaggttcatagatactttgctagaggatatagctgttttgatcaaggaaatatcagttcatccaaatgaatcgaaattagctgtcccatttctcgttgcattgatgtatcagattgtacaatttcgtcctagtgccactcataatttagcactgaaggattgttttctttttatttgcgatttaataagaatctatcatcatgtattgaaagtaccgatacatgaatcaaatatgaatttgcatgtagaacctcagattttccaatatgaactgatagactatttgataatttcgtattcctttgatctcctagaaggtatattaagggtactgcagtcgcatcctaagcaaacttatatggaattttttgatgaaaatattctaaaatcatttgaatttgtctacaaactagcactaaccatttcatacaagccaatggtaaatgtaatatttagtgcagtcgaggtcgttaatattatcactagtataatattaaatatggacaattcctcagatctgaaatccttgataagcggtagttggtggagagattgtattacaagattatacgctcttttggaaaaggaaattaagagtggcgacgtatataatgaaaatgtggatactacaactcttcatatgtcgaagtaccatgacttttttgggttaatccgaaatataggtgataatgaattgggaggattgatatcaaagctgatttatactgaccgattgcaaagtgtcccaagggtaatttctaaagaggatattgggatggatagcgacaaattcactgcccctataataggttacaagatggaaaaatggcttttgaagttaaaagatgaagttttaaatatttttgaaaatttattaatgatctatggagacgatgcgaccatagtaaatggagaaatgctcatccactcctctaaattcttatccagggagcaagcgttaatgatagaaaggtacgtgggacaagactccccgaacttggacctcagatgccatcttattgaacatactttaaccataatatataggctatggaaagaccatttcaaacaattgcgtgaagaacaaatcaagcaggtagaaagccaattgattatgtcactatggaggtttctcgtatgccaaaccgaaactgtgacagcaaacgaaagagaaatgagagatcatcgacaccttgtagatagtttgcatgatctgacgataaaggatcaagcctcttattacgaagatgcctttgaggatttaccagaatatatcgaagaagaattgaagatgcaattgaataaaagaacggggagaataatgcaagtaaagtacgatgagaaatttcaagaaatggcaagaactattcttgagtcaaaatcattcgatctaaccacactagaggaggccgattcattatatatctcaatgggactgtaaggcaacaatcaaaaggggaaaatgtcaacgctttatagaaaccttgtaatgcttaatattaactatatataatttatattattttcgttttaggaaagaacaaaacttatagataatatcaaatttaagcagaagtagccttagcagaaccggtttggaaaccgttcttaaatcttctggagacatgcttcaaatatctcattctaccggtaccagtagtgtgtcttctctttgccttggcagcccagttgtgagatctagtcttagcggatgggtaaccacaagaggaacaggtcttcttttgaacatggaaagaacgacgaccacatctgttacacaaggtgtgagatttgttgtgacgcttaccgaatgaaggagtaccctctgtttaaaatgaaaacataaaagttaattatcgttagtaaaactttgaactaaataaactctactgctggattcagaacaacttcattggcggtctagatgtgtgttgctgtcttacactatttcttctcacctttttgtattgacactcaaatctttttattcgctctttatgcatccgttatgtgcaatttcttatcatcaatggctctggcaacattcatcattctatatttttaaatcttttggcatagtgaataacgtaggtcttagtttacctggcctctcctggtggaaaattttttcagtgcttctttctcatgtaatcctctaaatcagaccggatgtgattgaacgttgactcatcaattaataattcctgtacatactacccatctttacttatatattcgtttacctctttgttctttatctacacatagtagtgctttttgttaccgctttctatagtaacctatgcttactattccagccatgtttccaatctcatccttcccgcaagtggcaggaagattctcagtgataatattagtggtgtacggagtgcttgaagaaaaaaaaaactgatatagaacccaaaaatgttcggcttttaaaatacaaatatgtacaggtgttaatgtctaaataatgataatccaaacgcgataatttttttttcgcgtttgtttttgtttcagaagaataagtaaacacttctgcctctcccaagaaagtttaatttctctccttatttgccgtttctatcgttactagcaacggggaacaatatatagaagcgtttttttttttggtatactatttacacaatatttgccgatttcattagtcttttcgctagaagtttcacgacaaaatcgtcacaattttggttatgtcccatctcttcccaccatcatcaccagttgctggtaaacctttggaaagcccacaaaaagaacctggtaagcttgctaatacttctgtattgaccttaggaagaaaacggtataattacgaattggaagagtatcctactccagacccgtcgtctagcatcggaagacaatcttcaccagtgaaagatatcacttcacgtttaaatgagaccaaatctgccttgtcatctccttcaaagcaagaaaaggtgcttgcaggccctatcgagattgaattagatgcatcggatccctcacgtttagccatcggtaggaaaaaatcagtctgcaacattattttgccatgcagaaagaatatctctaggcagcacgcttttatttcatacgccgccgacagaaatgaaataaaattggaatgtaatggaactaatgggttgtccgttcacttgccttactccatgcagttgcatttggtaaaacccttcccaacaaggaacttttataaactagtggcagaagagcctttgacctcgcaaaatactaaacaatcgcatggaaaaactcttcaaaagaaccaaaacttcatcagctttgttttggctaaaggtgaaactgttactttcccctatatccaaggaagtttcataaattttacaggcgtcacagtctgtctttcattgaaaaaagtagcaccttatcctggcgatggcaacaataactttgacgaagagaactcgacagaaacggaggatgagttgtgtttattaacaacaacgagcgatgatttttcttggcaaaaagaaacaccttcgatgaaatttgtcccagttgagcattcacctcgtacagaacagatctcaaaaccattacttattgcatctcctgctcttgtgaaaaactcccccattagttatagaacaacaccccaaacatctttcgttattaatcagccatcaactccaaagaaactgaagcgtaaatcaatttcattgaaaaataacactatacaagagacaccacttcctaaagataaaataattgggacattaagtgccagtactaggagtggtggcattaatgaagaagaatctttcgcagcagttgcaaaaaaaactaaagagctgtcttctacaaccgcgattgtatctcctgcacaaaaacgtcttaagacttcattgaatattattcccgaaatttctcggtcgctctcagaaagaggaattcggtttgatgacctagttcatgtgctatgtaatcatcttgcattttctaaccttcaacaaacgcctttatcccaattgcaaaacatcaattccaacacttcacaattaagcaaagatgaactaaaaaaggtcttggagactatttcttgcattggtattattgtgcgtgaaggaaaagatgcgtctggcaagccattagaagacgagtattactatgatgttgaaaacgatgatagcgacgagagaaagattttgtataattcgttaaaaggcaggagccgattaaggtcgtgcaggaagaaacataaacagtatttctggaagaggccgaccaaataacctcaaagacattctatatttcaaccttatttccatagcatagtcatattaccacgtggagcatcatgaaaaaaactggtaaaactcgtcaaaaagttctaaaaacataaagtaatattttctatatatttccgttgaaggagctaatacataatccatacaaaatagatcattatgcctagatgttattctattggtgtttgtcaagtttaagaatgtttaaaacttttctattgtatcattttctagtaattacatgactcgagttgagcgaatcaaacgataaggcatcgtcttctcaatatagggaggtgatcgggaccagcctagcataaagaaagggattgaaataattataaaaatcaaaataaaacatttattgtctaaatgtttaaaattccaatttctttggtttttcccatgagtactcttgattagtgaagtgaccataagaagcggttggtaagtaaattggtctagccaaatctaattcctttactaacacacctggtctcaagtcgaagttcttcttaataatttcaatgatttcgtcatctgattttgtagctgtaccataggtgtccacatgtaaagacaatggttcagcaataccaatagcatatgaaaattggacttggactctcttacacaaaccagcggcaactagagacttggcaacccatctagcagcgtaagcagcggaacgatcgaccttggaatagtccttaccggagaaggcaccaccaccgacggatgaggcaccaccgtaagcgtcgacaataatctttctaccggtcaaaccagcgtcaccttgaggaccaccgatgacgaatctaccggatggttggatgaaatatttggtattttcgtctaacatatcctttggtatgaccttttcaacaatatctttttgaagttgagttctcaagtcagcggtggaaatttcatcagcatgttgagcagaaataacaacggtatctatcctctttggaacccatctaccattgtcgtcttcgtattcgacagtgacttgagtctttgtgtctggtctcaaccatgggagagaaccatctcttctagcatctgccatagccatgttcaatttgtgagccaaaagaatggtcaatggtaacccttctggagtttcgtctgtagcgtaaccaaacattataccttggtcaccagcacctaagtcttctaagctcttttcatagtgcagaccttgagcgatatctggagattgttgttcgatagctactaaaacattacatgtcttgtagtcgaaacccttggcagaatcgtcataaccaatcttcttgatggtatctcttactatttgttggtagtcaagtctagctttggtggtaatttcaccgaaaaccataatcataccagttttggcagctgtttcacaggcaaccttggagaatggatcttgttctaaacaagcgtccaaaatagcatcagaaacttggtcacaaatcttgtctgggtgaccttcaccgacggattcagaggtaaataagaaagttttgctcttggacatgattatgtttgtatattgtcgtaaatactggatatattgaagacagttatgttttttaaaccttttaaaaaaagaaaaaaggggcagaagcaagattctcgaaaatactttgtagaaaggacagatataacctccttcttatacgcctcaagacgacagatgactaccaaaaagaaatcaagatctccttgcatatgaagatttgacgtcgtttacaagagctatctcagaaatttcatcggtattttggcttcggttaatatctggcgtggacccatcggtggaaaaacgccacagttttcaagctcaattatagtcacgtgggtagaaatattacactgcaccgcaagaaagtacgaccagatgaatcacatgtgaagatgttaacaagtttacatactttttgatcaggtaagctatgcataatgtcttagttttagttatgtaaagaaatgcaaacttttagtgcatattttatcttatataatagagcaaagctcgccagtgctccagttgttacctgagaatgaagcttgatcggcttttattctttcctgataggactctgtaagtgttactaaacactaaccggtgaaggaagtatgtctcttttcgccaagtttgtaaatgtccatttccagcaacaataaatgactaaaaatgctagaacagctccagagacaacatcgtaccaatgatgtctgtgatcgataacccttgaaaccattactactagagctaataaagggcaccaaatgcaacttcttgtattgcgtgtggtgaaaaccctttgccaaagatatgtaaagcccatggtactgactatgaaacttgaatgtccgcttggagtgctttttaagccttcgtatagaatccatttgttagtctgcttgcaaatgtccaagccaaaaaccaaagaatctgaatcactcatcttttggaggtcaggtatacatctatcaacaaagtcaggcctcaagtttcctataatcaactttaaggcgcctgttagggcagcatttatgcttataatcagcatcagacatagaatgctagtatgcatgaagtgaaaatcgttcgagattccgtccggcctctctcttagtctctttactctattcttcttcagtaagtccttgtcaaacatgcaggtccagaagacgaccatgttactcagtccaacactcaaaatcaaacattctagtgggcccacgagttcgttaggtacataacgttttgatatactggggtcatcaagactaaattcgatgttttggcccctaggtaccagggatatctccgaatagaggaataatatcgtacatagaccaattatcatgtactgaaagtagtatagcttaaaatactccttatgtttctcatccgccatgacagagatcatccttggtagaatatgacgagtttccttaggcgttgatgtaggagtttctcactcttgaaagcagtaaaatcacttcaaagaatggctttctttcttcccttaaagactataagttgtcaggtttcacgtggcaactacaagaaaaaaaattcttacgcgtgaaccaaaacaaaaattatcaaccaatacatgtcgacaaataatgaattagagcaatagccacgataacagaccttgattaaatgtaaactacatataagtttataagggttggttgattccattattttttgttttttatataaagcctatgaaaaataaatggaagcggctgttagaatataaaatagaagttgaaacaacaaaaatgtaagaaagttgccaacaataaatctcaaacttgaaagtgtggatcgaggaatatggacaatctttaaaaaatttttagtcccgtagtttttcgaatttttccttaccagtgaccatgaaaccatgattgggagacgtataagtaatttttatcaaagttaaacagaataatgaacattttcttctatttctccctgtgaagttttcatatagaaaaaaacataagggaaagaaaatattgataatagaaagatagtaccaaattgaattggcaggaaaataggtaaacaacgaacagaaacgataaaacaaaataacataaaaaaagtagacaaaaataaaaacaaaaacaaaaacaaacaaaaacaaaaacaatgaaaaaatgttaacaaaataatggcaaatggttgtcttttcttttagaaaatttatagttacaacaaggaaataacagatcatttaatgaaataattcgtgaactaattcttcatacacagcaatctgaaagttgtcgagttcaatttcgttcaacggaggtgcaaaattaactctgttattccccctgttctgcgaaaactcattgacattcattaaatcttcagcattgtaattttttactatgttttgatataatttcagctctttttgttgtttatcataatacttagaatcaatagacagattattcgggatggcacacaaccaaattcttgtcttgtaatatttgaacagctcttttatcaagtctctaaaatcatttctctcctcacaaacgtagtaaaacgttaattcctttctatcaaattggaattctgcgtttaaaatcttgatattcaatttaggctttgaataagttgcagcattcgtaaaattattggaagaactgtcatttgtattttgagattttgaattatcatttaacgcttgtaatttactctgagcaatatgcaaggcttttaattcatcttcaaatttattgtgcaaattcgttgttacctcccacggggtggcaaaacgtaagacttgtttagatggtatgattaactcagttaattcaacaacatcatacaatttgggatttaattttttcttttgcccattttttgagtcaatcaacatttgaataaactcatcattgcgatagtgctgtgactcacttgtaattaaagagtcaaagtgaattttctttttcagaaaatttataaataatgctaaattcaaatcgacagagggctcaacaaccaatactaaatcccttccacggtcaccatcaataataaccaagtcacctctctttaacaacaaattggtagcttgtggagtagatagtagttcaagtttcccatttttcaaagcaaccagtaccaatggtgtataaggtaaaaaggagttattagcattcctgcatgatagttctgttgtgaaagagcccttcctcctatttttattgcctccattattggaaacaattccattattcgactctggatcattaacgtaattcatgttgcaacttcttaaaatgtccaagaaatttaataaagattggtatgtattaccttcttcatcgattaagcccatgttcttcgcgtcgtaactttcattagaatcgtgcaacttcagcattttcttaatattatctgtgaattcaaaaactgcagagctagcaaaatagccgctgccacagtcgctgtataaatcgtgtaaggttttggacgaagtcaagtgtttaccctgaattaaaactaaaccattgtccaaagatacatttccttcattgctgttctcgttctgaaggttatgtgagtttgtagaagaagggacagaactgcttctttgaagttgaacaagctgaacatcatcaacacgttcgccattgaaagaagtaggtacattaacgtttcttggttgttgtggttgttgtggttgttgctgttgttgttgaaaagtaggaagggatggattgaagctcgctaccggttgtgtattccggcgaaactgttgcattggaaccatattgtgactgttgttgttgttattactattgctgatactggcattattaggctcgttatcataaggatacggaggttgtacaccatttccaaactcgggcacacctttggcggtcaaatgggttgagttcaagttgtcatagttgaatctgctattgaaaagattgaaaccttgagcgtgttgctgctgcacttgggatgtttgcttttgccgagcgtcaggcatttgatggttgattagagtatctgatatgtaggaggatctcctaatggtagactctggatgagatggctgttgccaattaaatgatggtacttgttggttgttcatactagatgggttgccagcactgtgtgatggggcagcaaaattgctgccgctattggaagtaaaacctatgtttgttttattcattaaacgcatgtagtctgaatccatccgattccccattaggtcgtttccatttgaatgaaatgaatttccattaaattgcgggaacgaccgttgttgagcttgataattacccatttgagtagagtttaaattattgttattggatgaaatgggcggtgcggacatcggctctgaattagacgaagacatttgaaaagaggtcaaattactggaagggtgttcttgaatgaacccgttctggtgagaaaacggttgctgttgttgatttggcactggtggcaaatacggaaacctacccataaaatcaatatcgtcaaaagtcctcctgttttccataccatttcccgcactttttattgagtttctcaaattattcaggccagcaagcggatcaaccgtatcacttcctgaattattggagttatcattcagtttacggggtaaatcggatagcgattttccgctgttattcttgaaaagcaagtcctcatagtagttctttaaatccacattgtcggaaatgcttgttgtgctattaacagttgggaggtccattttgcaactgtatttctattgagcactgtatcagacaccgctttttttgatttatccttcgtttttttctctataattctcttgagcctttcaatacactttattcttttctatatacgctgtttactatatcaaagaacactcgaactgatgctatctctgtttctaactgccgaaccaatgaaaaatacagctcttaattatcagtgaatccttcttcttatcctttatttatttttgttttgttcctttagctaaaacacggatccgtaatgttatccaacacgattaggggaaggattcgtctccaaaaaaccgttatgacccaatcctatatgacctacggcagtcagagaaatacaggttttcgcactcggaggcgattgtcgccaatggaaagctagccgatactttttccgtcagctttgcgggttttcttttttgcggccttgtaaacggctgtgggaaaagcgaaaaaaagcaatgagttgggagaaatggatgtgattacatgagcaaccagtagaagatagcatcaaccgcacacatgattaggatgtagacggctattaccttggacttattttgttcaagtgcggctgtatggacaacagtgttagggtcaggttccttggtagggtacgataatacagctgtagttgcttgtttggtactgtcctcggttgttgtcggaacctcaaagacaatgccaagccccttcatcatgtgccactccacatgacaatgtaaaagccattttccgggcatctcggtgttaattctcaaaaccgcgtaagaatttcctgcaatgttaatgctatcccttaccatcggtgcctttccggttcgggccaggtgacgtaaatcgttctgatagcggctccatgccttgccctcttgtacgtctttgtgaaatgggccatcacctttattgccaagagatattatctggaagtgatggccatgcatatgccatgggtgtctcatgtggtccagtgagttgattacaatatcatatgtttcgttgaatccgaaccttaccgggtcttttacgtactcgctgaatgtccgttcgttcaccttatacatcccagtcccatacttttgtttcgtgctttcatctttgtaataagcataatcgaattcgaaaactgcaacaggatcagcctttgtgcgtaactttttattctcttcttgcgttggttctatgtcgcgataaagctcggccttagtgaaaccaggcaagtgttcgatggaaacgtcattggggttctttggtaggtccaaatgagcgccttctttgtaaaaccaccactgttttgttatataacccatcattttgttacagccattaatcatacgaataaaactagtgtcagactttagtttgaccaaaattgtatatctttgtccgaccgctaaatttatcgtttgtacaatgaacggtttaatcataatcccgtcggcttctagaacaattaattggaatccatcaaggtgaaagacttgagtaccagacattcctgagtttacgattctcaaaagaagatactcggtgttaaatcctattttgatagtttcaccgtcagatgattttccatttattaatgatccatcaaatttgggatctgtacccccggtagatgacaaaaccttgtcgtttaaaatgtccaaattccaattggtataccaatcactcaaagtgataatcctttcttgaacttcataatccgtcaattccttcgtgtgtttatcttttttcattgtaacaacaccgtcatctagtgtctctatgtctctcacagaattaatagtatttgccacatgattatcataatcatcgcattcaactatcagaacacctctcataccgtcaccgtattgtactgatgaatgcgaatggtaccaaaaagtaccacaggttgattgatcaatggtaaaattataccaataactttctccatatccaatagtgggctgtgttaaacctggaattccatcaaattcatttgctaaaggtaccaccccatgaaaatgtaaagctgttgaacagtaatccttccaaacatcactgtctttactagcttcttcttctgaacatatccagttagtcaatttcaagttaagagtgtcaccggatttaactcgaatttctgggccaaatgtagcgctgtagccatttatggagataactcttctcttatcaagcgtgtattcactgctcgcattgaattctaagacatgtattttgccttccttagcggccataataaattttaatagtattaagagtagcattggcaactgaaccggcttaaggagaatgaccttcattctaaacaagttgtccacggagttttgcaataattacttaataactttgtttaaccgcccagtatgtgccactttattagctttggccttaatgtggacagctgagatgaaggtggatcctctatgactatccccgaaaaaaatgtaaactaaaaaatattggttgctaagagattcgaactcttgcatcttacgatacctgagtattcccacagttcactgcggtcaagattttttcttgaatcaggcgccttagaccgctcggccaaacaaccacttatttgttgaaatttttgtatcatatgtttgtatatatcatatcccattttttaagagagtaacttcttgtcggcctcattgttcataatttgtagccaagttgtagtgataaataataatttaggcagatattcttatatgcttgagtggaacttctagcatattcagtatacttgatattaaagcctttaacaacaattaatgttcggaaaattaaactgttacataatttatgtttagctcttactttaatcccaaagagggcaaatagcttttaaatcttcaactactataactataactacttttctttcatatatagttagaaaaacaaacggttatacaaatagtaatcaacacgatattttaagggtaaatataatagtacatagagtccagtacctccattagattgttatttaaagtattaatacggaggggaaaaaataagcaaaaataatatgagcgaaatattatggcagaacaaaacgaaggagacaaaacatgattgcattacattagcactatttttgtagaacgccttccttattcaggacgttctcaacttcattgaccaactttttgacagctttgaatgaaccagaaactttcttgaactgcacaacgctcatcttacctctcggataaatattaacctcaaagagtgttgaacgtagtgagaatatattatcactcgatagtttacccgttaaggtcagattgttggggtgcgattttatattttttaaaccatactgagtccaaccacgcaacagcttctctaaaccattaaacaattgttttgcagaaatcttggcatacaattccattgttttgtccgaagattttgagaattttctaaagaaggaaccatttccaattgctgtatttttatcctgcttatgctcttttaagtgatcttttgaatgatcctttgcctgcgagccagcatttttttccctaattttttgcacagatttgttcaatggtggctccatatcatctactactttctctcttttttcttgatcctcttcttgtttgtgttgttctggctttttctcttccttttcctcattttcttcttccttttcagtatgtgaagaagagcctgattctggtatcatcgatttaatctttggatgtgcctggtcaccctcttggctattctgtttacgcaattcattgtcaccattaagcggaggaaggatcggaagatgtaagttatcagtttgtttcgcttcgttcgatccattaaaacgatctgcaaagttcagctttaacgcggatttgtctttgatagtggaatcaccgacatcgtacaatctctcatcgttcgaactatttcctgtatattcagcttcttcgttgacagtttcaaaaagaaattctgaatcatccgcacttcttggtgttggaattctttggctttgttggttattgacatcaaggttaccgtttttcaaaatatcaaccaagttggtaaacgactccttggtagagtacatcgacaggacagatagccttttattggactcactaaaatgccttgattttctagtaaattgtggtactctaatttcagagatcttcctcaacctaccatcagagacgggagcagttgttgcggtactatcctttaattgagatacgccattcccatccttcgggaggatcaaagattcatatccatcattagaatctgacaccactcgctcctctgacaatctttgtggtgcaattatacttggatattccattttagacaatttcaactctttatcgatattaaatgatgaacccaagaattttgatcttctgatagtttctaaaattttcttttctgttgtaagtctttcattttctgttctctttggttccactggacttacttcctcagttggactggagaacattatacccggatcaagccttgacacaggtctagtttgtaaagaaaagttgcggcgacggagaatattgtcaatatcaacctccaaatgattgatatttttctcttcattttccataggagcagagatagatctaatattaccatccagtttttcctctttgtgtttggacagctcttgctctagatcacttatatcaatttcaatttgcttcttgagttcctcctgttttcttttcagatcttccttttctagtaattttcttgcacgttctttttcttcttgtttacgtcttctacgttccagctcttcacgtgcttttgcttctctcactttacgttctagctcttccttctctttccttatttgttcgtacttttcgtactcaaaaatttcatctatcaaagttgcaaaatttgagctcgttctctttgtttccttctcaatgtattcccaatcgtcatcctctgccaatttcgcatatgttgacattaattttgttgtcaccgattcacgtttcatgcttggtatcaatgacattctcttgatagatctagaagatcttttgttcttcttggtagtagaaaagatagaggctcttttttgattcttttccacatttataaccgaagctcttttattacgtgatgctggtgttggagaagattggttaacgattgtagataatttcttctttgaagagaagttttttgaaaggcgttttgaagaaccgggtgtagttagattgctggaggaggcactggaggcagtgaatttgttgaaggatattggctttttacgagaagatgttacactaattaaagattctctatttcttctgcgttgtggagttgtcgatacttttttagatggggaaacagaaacgctactaattgactgcctcttcttaacttgctgttgcttaataagctctttttgagtgtcacacttaaatctatacagtagtgcatataatgtcttttctgcattagcgccaggttctcttagtttttccttaattccttcaggatctcttccatgccataatattactaaattttgcaaaatcgtagcgtcaatagaagaattactttctgataatggcgtgagatatgtgtcttctcttggtaagcctctaatacttttagaatctcttatacttggatatttttgtaatagcggatgtttgagtatatctctggtcttgattcttctttcaggatcaacggttaagatttttctaatcaaatcctgagcttcacgcgaaatttcatcatcagaaggcatttcgaactcacctttttgaactttaagtaatagtgttcttatatttccatcttcctcgtcaaagggtaaccgaccagtaagaagggcgaataggatcacaccgcatgaccacacatcacttgcgaaaccttgatacggtataccagatacaatttctggtgcagcataatgtggtgatccgcacgacgtctccagtagctttccttcagtttccaaagcagccataccaaaatctgcaatcttgatgttatatttatgatctaataatagattttccggttttagatcacgatggacaatacccaacgcatgacagtacgacacaccaataataatttgtctaaaaaacctgatagcttcatgctctggcagaggacctctctcaaccaataagttgaacaactcacctttctccgcgtattctaaaacaaggtataaatctgtatttgtttcccagacatcatataaacgtaacacatttgggtggtttaacaacttcataatgattatttcgcgttctataccatatggtagagcatctggggtggtggagccaacaatcgaagtaccgctgacattaccggtattgaatactgcttttgatattaccttaactgccgcctcttgtcctgtggatccattacgagcaagctggactttaccagtgctccctagaccgagagtttcacctagtttccatggaccgatggtattatcctttatggcaggaatactgttaccattgattgccattttgaatgttattattgtattgtgctgcgaatatctttcttgatcaaagtgggcaattaattattcacaagtctgctaaagccttcgagaatactaatggtgagtacagttgagacgttgtcgacagaagagaaagcaaaacaaaatagaaaagaaaatcaagaagaaataaaaaatgtgtgcacttcattcagtcgcttttaatttaacatcaaaaggaatctatggtgtggccgttgatatttcgcgatggtatgccgaaaaaggaaataacgcagattgcgcgtagtaacgaatggatttgacgcgtttccttcgatgaaaagtgggaaataataataaaaaattcttgtcagacgaaacttggcgcaaaacaaatgatttctttaccttgaataacccagttcttccagtgaagtgaagttcaagttagtaatagtaggaatgcatttatgtgatgacaatgatgtttgcacaaagtacatagaatatttaaagagttaaatagtataatgaaataagaaatacatgaatgagggggacgggagaatgaaaggaaagagataaaacaggaagagcgtgtaggaaggctgggatttgaaataatatgctaattgaattgtttcttcaagtttttttttttttttttgaatcgtgatttctgctttaacaccagaaatcaagaactcttttccagtatggtccgtttcttaatctctctttatattcttcatcttcttgttttaataattcttcatcaaagatgtttctatgagaaactaagtctactttatcagcgggaatgaataaactccaatcttttttccaaactttgtaaaagatgtataaagcaatccagattggcatagccaaataattctcaaaaaatgattgggcacttaacttacctcctccaccaattggggcaatggcaacccaaaattgggcgattaaagctaacaccatcataaggacagcgtaagccgacccccagacaccgacttgagatttataaccaacctctcctaaggaccttccttgcactttcatagctcttctaaacctaatgtgagacaaacaaatggtaatccacgtgaataattgagacaaaccggagattgctaacaaccaggtgaaaacgtcctcttcctttttagatgaggcacagaatgcaatgacaccaaataatgcactgacaagcatagcagcagcaggtctaccttccctatcgatgtaatcgaaacatttgggtgcattaccttgtttggccaacgacatcaaaatacgagaactggtatagaaggcaccgttagcaacggaaagaacagacaacaggatgacagcgtttatgaaatgaggaaccacacgaacaccatgagaggagacagcgatgacgtagggcgacgctttagtggctgaacctgcggcccctagcaattgatctgaggtgtaaggtacaaggaaaccaactaacgttaaagacgccaagaacacaaacagaattctataaatcattttctttgccgccgatggaatagcctttcttggattggattgttcactggcagtcatagccagctgttcactcataccaaaggcgaacgctgctgtgacaaatgtggcaacgacacctttgaacctctggatgggtgtatcaccacggaaggctccgggatcacgccaatatttgctacctatgtaaccatcggtacctgcaccaccacaatcaataataatggcgagaatgaaaaatccaactatcatcagaattttacaacaattgaagaagaaatctgcctctgcataacccttagctccaaaaacgttgataacaacgattagtacgtagaagataacaacgaaaacatccgggttcacagatgtcgtccaatatttgatagtcatggatgcagtgaccaattctagaggacaaacacatagccattgtaagcaaaaaagccaagcaacagaaaagccaagtgcagggtcgaccaaaaacaaaggatatgtattaaatccaccaatcaaatcactgtatataaccgctaattcaccacaagcttgaataatacagtaaacacaactacccataatagcataaccaatgatcaaaccacccggacctgcattgttcaaaactttggagttaccgaccagcaaaccagtaccaataccagtccctagggacatcatcaccgtatgacggggctttatactctttttcaaattttcttgtttctgttcttgttcttgtggtgactgtttaataccatcaacagtgatgtatgagctcttccgattcaactcattgtccaattgagagctggaatcttttgtggatataggagtagtcccattagagttgctcgagtctggggaatttgcatgcgagccttccgctcttctaaacgagtcaatgaacctccgtaagtaagatgcatgatgttcaccttcatattccatattttcaatggttttttccactgttttttcaaaatattctacttcattttccggttctatagagccaatttgtttttcctttggttgtatttccttcatctcgtaatgggaaacatcgtcaaggtcgttacgattcatattcatattagagcttccctcattattccgcccatggcgtctattaccaagcgtcataatgtgcaatatttgatattatataagctacttgagaaagcgatagtttttttttcttacacaaaaaaaaaaaaacataaagcacctataactctcaactttgaagaagcacgaaaggaatatgtttaaatcaacagaaatgtgaaaaaaatcggttatatatacagaatccgattctttctaacatcaaagaggtgggggaagaagggactcaaaaaagaaacgacactgcacaacccgagccaaactgacatacgaacactaaaaccgatttccgaaaaaaacttcaaatttacatttcattgtccgtctgccatcgcatcatcgccttcatctctaagagttgccgtgcctttccatccgctttcttttcatgcggcgttattcttttttcctatttttgatggtccctgtgccgtttctttttcatgttcaccggtttttggcgccgcataccgtacggcggggcacttttgaaacgtttttgtgcatcctgatgccgttttcaaggatcgcaagcacgtcgcataatacggtaatgccgaattaaggctacgtcgtcatagtaggttagtcatgcgcgttggaaaaagaaatgaccaacgcgttgattacgtagtccccaaggaataatgcttttgaaagtgaaaaaaaaaaataaaactgaaaaaagccatgctgtttccatcacgtgcatgtcacgtttttgccgccgaactctttgatcatgtgatatgaatatgttgggttacccagctttgccaacacgcgccgtcggaaggtgttcaggaagcaggaaaagagcaaaacaccaacaatcaaacaaacgaacacattctactcttttagttgatttttcttaccttttccaagctcccgtttcttgttaccacctgtagcatataggacagaaggacccagttcagttctagttttacaaataaatacacgagcgatgtcggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaagattcttgtacgacggtattagaattcaagctgatcagacccctgaagatttggacatggaggataacgatattattgaggctcacagagaacagattggtggtgctacgtattaggactcttaacaatgcctaaaaaacgccaacaaacctctcccttccccccacccaccaaaaaataccatagtaatgaaaaaactaaataattcatattatataacatagtattaatatatgttcgacaagaatagttttgtccacgcctctttcccagctgatgcggaggaagtgcttttcgccatgttattaaccagtacgctagcttttgttcttaattaaagaaaaaaaactatctccgttaaatgagcaagtattaaagaagcattctttcacgacgtgccacagagaacttcccgtcttcattcaccatgaacaacaagctcatatatcgttcggttagatttgcaacccataacagccagcttttacttccacctttggttctctacagaaggatactaaggcagcataagctgctacctggtccccaaagggagatgggtgaccaatacgtgcgaaacgagttcaagttgcacaaagatatcgataacccgttgcatatagtcggctttttagcttcctggcaagattatctccacatgatttccaacggtaaatggaaagatgccactttatcttcggaaaccctggagaaactatcccctgagcaaacagttcaactgtatgaattgatgaaggaaacacagaaacttcaccaagacaatgaaatagaatcaagtaaggacgtgaagcggaacaacaaggattagtgttcgtctttttattgcgcttgtaaataagaaatccatatactatatagtacacatgctaaaaaaaaaaagctaaaaatctcacttatttgcagtggtctccctctcctgccatataaccccactggtattttccaatgccttattgttggaaacctgatctttataccattcctgcactttcacagggtcattgccgtggataatacaaaacttgaatttggacacctgcttgtcacatgatgtaaaatctccatatctgtaatagcttctaaattgccctccaatcgaatagcaactcgtcagttgatcaaatgcctctcggcaactcatcgttgtcggatattttgtactcatcctttcctgtttcttcctcaagctgctctcttttaccctaatagaaccatcgcctccctcttgatttatgctaataccacatccaatagcagaactattactaagatccgatatttcggcccccttcgcaaaggggcccgccgcactttcttcatgaattttcatataaaaagtcccaggacgccaagaaaaggtgccctcttgattaacggacactccaactactgttatatattgtttcatggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatagtttaaattacgctaatatccccttcataatatttacatatatatatcttttattatctatatcttaaatcacatatacctacaaaacttctagctagattcacacaagagtacttttgaaggctgcgcgtgcattttgaaaccaatgagacccgctaaattccgtctgaggtacaagatccctcggcttctttcttcccttatcatcaactttcggtttgctattattggcattcatcacacttagcacgtacgacattggcaaaattttgggttcgtccgcctcacgcttaaaccattctcttatcctatatcccattgtttctaaatcatctgccccaatttgctttctaaagttataatctcctaacttcagcatcaggagcaacgtgtaatatgcatcattgcctgcgttatgtaagaaggcatgtggcaagtgaaaaagccttagtagtttacctaaactgctacccttcttgccataacacatgctataaattttctctgtgtcaagcatcttaacatgttttctaacacctttgctctccgttgagtcctccggtttggtaagttcattatccaattcaggtacatggaccccaattttcttcagccacttaatatcccccgctatagcatgacccacaaacgctctttcccaggttgtatcttggtccgtctcacatttcatatagaaattaatcaacgactgaatgaactctacacattgttccaatggtaatacaagactttctccaagtaaaaagcagtctttaaagtcgcatacgaatttcttgtttcttaacggtaacgcttcagcaacaattaaatgataacttcttataatcggcatcaaggaataaatgttttctcttggatcatatatggcgatgccaatctctgtaacaatgtctgtatcaaattcaaatgcctctacatcgatggcaaaacaaattgtcttgttggatgataataactcaatagttttacagagatacttgaactgagacccaccaggttcacaattcatcacaggtatatgttcgttttttacgtcctgtacatctgctaaatattgctttcttagatttttctccacatcgtctttagatgcatcaggtatacacccgtttttctctatccatttcttgtcaatttcttccagcttcttatccagtaattctgaacttttctcatagatggaccgatagtttgtttccaatgcctttaaatatttttggatttcactacttaacgcaatgttaggggtatatgcaatttcgtgcagagaattaaaatgttcaaactcatttatccatgtcttttgtcttcctagtttattcatcaacttgctacttgaactcttatacagtcccacgccccctcttcttgaagggaccatacccctaactctagctgcattgcgggttgccagactcctgtttaaaccttgtggttgatggtaattgcggactgctttggagttgaatctatgcgtaaccattttgactaccgcttcgtatgctttcttgcactttgtggagctactcatacaatagcttataatctgtgtagtcaaactatatactaggcaaattactagtaaatgcagtattcatatgtcctcaaaccgttttttgcagtatgttattgatccatcgaatcaaaatttttcaccgccaagagaaaaaagatcttactattttgtgcttatgaaaaaattagtaaaagtaaagctggaagcacatacaagcgcagctgaatcacaaaggaaaattggcacatccttggttgacacttgtctatttattaaaaggttttaaaaagtagtgttcagcagttctatcatatttttttatttaaaaaaaaatactgagaggaagcgtattgttaagacacaatttagggtggcgttaaataaacgagagagcccaaaaatataaccaagataaagaaaatcaatcataaagtgaattcaaaaatgtcatcgcaaaacctcaatgataatccaaaaaatacatcctcagcagctgaagataagaagaaacaaacttcatccttaaagttggcaccaataccaaccacatcgccatggaaatcatcttcgccagatagcaatacagtaattcctgtagaggaactaagagatatatcaaagactgcaaagccaagtaaaaatggttcggggtcaattaaattaacaagcaataccaaatggactccaattacgccgtctgttataatctcaggttccaaggacacaaattcaaagtcaggaaagaactctaaaaattctaagactaataaaaaaatgaaaaagcgtggcaaatataataacgatatcaataaaaaggactttaacggtcaaaccaacagtacatcggaaataagtaacgtttccaatcttgaatccaaacctttagatgctaacgctaaagtaaacatacattcaagctcaggagcaactgccaatgggaatataaagaggataacaaacaacaacaattcaaccaacggtagacaatcaagaaattatcaaaacaggaatggcaaaacaagatacaacaacaatagtagacacagtcaggcggctaataatgccatctccttcccaaataattatcaggctagacctgaatatattcccaatgccagccactggttgaacaacaattcaagaaatagctataaacaactgtcatacttccgtcaacagcagtattataataacatcaactatcaacaacaattgcaaacaccatattattactcaatggaacctatttttaaatctatcgaaagtatcaaaaaccaaattgaattctattttagtgaagagaacttgaaaacagatgaatttttaagatctaaattcaaaaaagccaatgacggatttatccccatgagtttgatagggaaattttaccgtatggttaatttatctcttggtggagacccaaatttaattttggcatctatgagagaagttttacaacataaagaaacaaaccatttggaaattgcccttggaagcatagaaggtgctcagaagaacatggcagatgatttcaatccattggaaaactattttattaggcgcgaaaattgggctgaatacgctatggaaagtaattttgatgaaaatgatgacgaaactgaaaaatacaacattgagaaactattgggaccgaacgatttagacaattattcttatatgggctatccaaacttctttcccagtaatgaaaatgggaaaaagagtcagagctatgaccaaggtgaaattagcaggcagtttgaacaaaacttacaaataaatgattaattttagacaatatttttttttttttttttattatgtatatagttaacatgtataaagtaatagcagattctctctaaaaatataacataacatttcatttcaattcgtactaaataattttttatataacagatacataagatatttatatagaggaaaacgaaaacaaactaaaaataagctgttaagaacagatatgttttatgccaccagagcacacaaagctgcgccaacaccggacccatctttggctagacgcaaatgtatcttacgttcaccctcagtgccaattggacttaatgccaaagcatgtctcagcatggatctgaatccaggatagtattcgatgacataaccgtcaaaaccaatttctacctcaccgtgatatcttttgttcaaagcgtttgtcttgattaggatggcggcaatcggaacggctgctagatatgcagaccttctcgtaatggaacggaccagattttgaattgctttacgttcttcaaaagtggtcggtagcctcaaactctgcaaaaacgacaattcagtttcacgcaagtttgtcgaatcatcgatttcaatcctggaaagaacttcactgcacaattggaaaggagtctttaaacggtgaggtaattgatcgtaattacgatactgtcccaagattaagccccttgcatgcaagtccaccaggatgttccttaacagctcacccaagtacatgccggaaattcttttttcaaatagatggtaacctggatttggagaaaatttttggtcaatatcgatgtcatactttgtagcagacaaatgtttcaattcattgtcgaaagaaccccattcgatgttgatgcacatttgggtttttccttcatgcagcagtcttgttctgagctcatctggtagcttcttgatgttttcaatatcctccatatagcaaccgttagtaccagtaccaaagatacaaccaatgacaggctcgctaatctcaccagcactcgatggacgagagcctgaagtgtagcagtgggataggaaagtgccaaccgtgtcgttggtcaaagctaccacattaatcatagagagcccctgaatgtctaattgctcctggtataacctcacgacatccttgccgaccgtgtcttcaatcttgaagcttttggtccatctgattaaagtaccggaactcaaagaggtttggtcaacgggatatgagaaggtaaatcccattttcaaaggttttatgttctcccccgtggacttcaacaactcaggatgatgcttcctaacgaaggcccttgtacggcgacccaggtagctaaacagctcctcgctggtgacatccttgtcatttagatattcttccggaatcttagacttcaattgctgcatatcaaaggttccgtcaccattcaaagtcacagaacacactctgaagtgagtcccacctaaatctgcagccagcaaaacaccacgttccgtcccattgggcaaactggttacatatgtagggatcatgggtagacccttgtccaccgtcttttcttcgcctacagaggtgttattcaaccccttttccatacattcaatgaagtacgctgttagttcgtccaactttgctgcatcaacctgcaatgaggagcagatctcaaccactgcatcttccaatgcctcagcattgactttatgtaaattttcaaatgacattactgtgtatctatgattcgattcttgtacaattcttccttgatacactgatatctgtttctatttaaacttcctataagtatgagacgtacaaaagaacacgagacaagatgagattttacacttacacagaatcgactttatataatcccgaatacatgtttcccccccctgcatcgcaagcataatagaattcgacgacccgatcttcttcctctgtcttccacacacacaaacactaattcactctcactctctcactttccctttcgacgacacacacaaaaagactttctggatgccccgcgttttttgtcacttgattcttcgaacaaagacgcaggcaactacccctgaagggcccacccgaaagtagttgctactgctcgttgcggtggctgccagagtggcgacgtagcgttgcgttgtggctaacattggtgagacaacccgattaaattacttaatgggctctcccaccgcctttgcacccagtgacagccattttgaagatagcatcgggctggcttccaaataaaatctaggtcgtttctattaagttcgtttcgttatttttctgtcttcgcggcggacacgcaagccgacgacgacgaggtttagttgcattttggctatcataaaagaaatgggcttgtcgcaacgggatcaggaccaagaacaggggtgctgagactactactgtaactgcgaccgacacagcgtgcgaaactagggaagtaaaaaggtataggaagaagaactatgtttagaatagctaaaaacctcgtacggacttttgagcagagcgtgcaagataccctggcactctcgcaggactcgagcaatctggacgctttctttcagtctataccaccaaatttgttgtctgctcagttggaatcacccgtagatgcggtttctgaaggtgttaagcacaccaacgtcaatgaaacgctttccggtctccgcattgtttgggtggacgagatgcagttccaactgcagtcctttttcgactatatagtaggtttcaatgatgatccggtgccggtggtcagtaatcaacacggattttcgtacccagattaccgtcgtatcacatccatcttcaatgaacactgtggccgaactttgaaggtcaacatatggtcagctaaaggaggcacgttcagagacgagtatatcagcattatatcgaaggagagcgacgatttggacgatgtttctctaaaccatgacgagaggaggccatctagtggggaagcgcaccagttccaagcactcgggttcaaagtccaatggacgcctttgatagcttccactttcacataccatatcctgaacgtgaacatcccagatggacccgcccaatcggcagggctcatcccagatgaagactacattatcggctgccaagatggcctgttggccacgggaggggagacgcttttacaagatattgttagatcaagagcaaactacgatctggtcctttatgtctacaacaaagtttctgactgtgtgagaccaatcacagttcatataggtcccgacggcaggttgggttgcaacgttggatacgggtttcttcacaggattccaacagtaaagcactgtccacaacaagcacagcagcaggggcaagatgacaaccctgttcctgttcctgttccagtagaatctgagacggcttttgtgccatcagcattcacagcaccaccggtgccaacaaagaagaaatcaaaaaataaaaagggtacccagccattggcaatggatgactattttaatgaaggcagagataagtcatctaccgctgcgaagtcagcagaatctgacatcctcgccccaccaccacaaaaacagtcatcctctgattaactttcctggttagtcttttggttttgtttcatagcaaaattaaatatatatatataagcttgctttcccttcaaaacacgtaaacgatagttggcaatgtacgaaaagtaccgagactttttttcaaaggcacgcgtgtccttttttgttaagacaatagatattttagcattcagaaagtttcaatttccaagacttgacgtttcaattatatggcaatctcccaacaagcacccgctcatataataccatgcaagtgaccacaagatttatatctgcgatagtctcgttttgcctgtttgcttctttcacgttggctgaaaacagcgcaagagctacgccgggatcagatttactcgttctaacagagaagaaatttaaatcattcatcgaatctcatccgttagtcctcgtcgagttttttgctccatggtgtttgcattctcagatcttacgccctcacttagaagaggccgcctctattttaaaggagcataacgtcccagttgttcaaattgattgtgaggctaacagtatggtttgcctgcaacaaactataaatacctacccaaccttgaaaatctttaaaaatggtcgtatttttgatggtcaagtctatcgcggtgtcaagatcaccgatgaaatcactcagtacatgattcagctatacgaggcttctgtcatttatttaaattccgaagatgaaatccaaccatacttggaaaatgcaactttaccagtagtaataaacagaggcttgacaggcttgaatgaaacgtatcaagaagtcgcactggaccttgctgaggattacgtctttttatcccttctagattcagaagataagtcattatcaatccacttgccaaacactacagaaccaattctgtttgatggaaatgtagactctttggtcggaaattccgttgctctaactcagtggttaaaagtggtaattttaccttactttaccgacatcgaacctgatctcttccccaagtacatttctagcaatttgccgttggcttacttcttttatacttctgaggaagaattggaagattacactgatcttttcacgcagttaggtaaggaaaatcgtggccaaataaatttcattgcattaaactctacaatgttcccacaccacgttagattcctaaatatgagagaacagttcccattatttgctatccataatatgatcaataatctgaaatatggtttaccacaactaccagaagaagagtacgcgaaattagaaaaaccacaaccactagacagagatatgatcgttcagttggtaaaagattaccgtgaaggtactgccaagccaattgttaagtcagaagagattccaaaagaacaaaagtccaatgtttataaaatagttgggaagacacatgacgacattgttcatgatgatgacaaggatgtccttgtcaaatattacgcgacatggtgtattcatagtaaaaggtttgcgcctatttacgaagaaattgcaaatgtcttagcatctgatgaatctgttcgcgataaaatcttgatcgccgaagtagattcaggggcaaatgatatcttaagttttcctgtgacaggatatccaaccattgctttgtatcctgccggaaataactctaagcctattatcttcaataaaattagaaatttggaagatgttttcgaatttatcaaggaatcaggtacacatcacattgacggccaggcaatttatgataaattgcaccaggccaaggattctgaagtgtctactgaagataccgtacatgatgaattataatcaataaataaagcatatataatgcacatttttaacatctgattactcgcatcgtttctggaagaaaatagctaatattcgttatttatggcatcacgattattctcaccagttacccgtttatgctcttgaagagatttagcattactgccagcgcatcttcaaatacaggtttatatgagacccattactataaccctaagaagagaaaaaggagtgctttcgttttcaatcacattctagtttacagtaattgagtctcgatgatgtttaatatttaccttttcgtcacttttttttccaccattcttgcaggttccctgtcagatttggaaatcggtattatcaagagaataccggtagaagattgcttaattaaggcaatgccaggtgataaagttaaggttcattatacaggatctttattagaatcgggaactgtatttgactcaagttattcaagaggctctcctatcgcttttgaacttggcgttggcagagtaattaaaggttgggatcaaggtgttgccggcatgtgcgttggcgaaaaaagaaagctgcaaattccaagttctttggcctacggagaaagaggtgtcccaggcgtcattcctccaagtgctgatttggtgtttgatgtcgaattggtagacgtgaaatcagccgcctaggtaaattggcactcaggcacatatctgcaacaagatgcatggagtacgtatgtggcaaacttttttttatagttgaaaatatatccatatgaggatgccagccatcatgtcaagtttcaatgtaattatggttgtgtatattatgtttgcagcaaaataaaataaaagggctctaactacaatatattaatataaagaaatgttattcaatctagtttgggtatgaattttttccctcttaataaaaatagtttaagtagtttgttcagtcttcttatcgctggtaaacattttttgggaatttggttttaaactatcaaaaaaatcctgaaaaaagtcttcaaaggaattgaattggtcgacgtcaggaatcatgaagtgactactggacaagttctcgtgcaaagtaccaacattagtaggcgaagtagcgggtttcgcggcgtgcagatttcctgctcctgtgtagttattagcattagtcgacattttatcattatcactattctcttttgacaaactgccaaaattaatacgagtcttactagtatcaattatagattttatgatttttccaacgttatcagtagcctcattcattttttcccctatagtgctcaaatgccagtacacttttgtacaaagactcaaaacgcgttgacgttcagaagaatcgaaccaataaagatagtcacaaagagttaaacaggcgtagactagttgatgacaagtaaaaatcggagcaccccttattaacgttggcggtagtctcaaaaacccattcaacagcgaaaatgaatgttctttcatcgtattaagaattagtttcaaaaacctttggttgctttttagcgtggaagaaaattctgtgataaaagtgcgacatatcatgatatgataaaaatcaaatgtgaacaatagcacgcccgcgccatcctttgctaaaagctcttcccaatttttcagccaataatttagctctggaaaaacaaagataaaagtatctgcgttacctccatatctgtcattgttaaagtcatccaaacactgcgcaaaataatttttaaggtttataaagatgccatttacgatgtcacctaaatttatctcactgattttaatgtcatcaccaaaattcgcctgaggaaatttcgccacaagtttattaaactctttaagcatatcatcctgttccctaatatcgccgtaactaatggaatattctaaatagcaggcagttagtgaatttagtattcttagatgataaagatcttcgggattatacacttcttttaccaaaaccctatcctttatctgataaaaatctattacatgtaacaagctattgagcgcaaaattgcttagtaccagagaattaaacttcagttgcctatatctctttgcctttcgcgaaatatggaacatacagcaatataaaatagcctcaatatcaaacgctgttaacttttcaaacatggttaacgtattagtgagtaatctctccactaaaggatacaatatttcttgttctgcagcgtatttatcgttgtcagcaaaactcatagcgataatagtaaaaacacttgtaataaataggtgtgagtgggcatattccacgtctatctcttttctcccacctggaattatccagaaatgggatctcaccagaaattcttttgcaagcttatggcataattcctgattattctcataaaaatggagaaagttcactcttgcaacagcatatggcctttgctgtccagctagcttcgcagctttagatgtagccttcgatggaaatagcctctcatcaatatcatgtagcaattttaaaggagattccttcaacttaaatccatttaagaaaagattttcttttctatattcccctgttttccttatcgtctctgagcccgaagttagacgactatcgtacgtcttatttgagctgaaatccacgttctgaatatcatctccagggcctttgatatcgctgttataagacatctttgctgtggtgattatcaagtccattttctggtgtaaagattttatgtgctcttctaaagatgaaagccttttatcgatcatgtaattatcaaaattgaccgttccattcttttcaaaactactttggctttcgttgggagagtccgcattcaaatgagagaaagaaccaaggttgtgattaattgagttgatcttctttagtagaccatcctcacgtaaagtattcaaaatttcattgtctttattcctggctaaggagcaatcaagctgcagaacgttacatctgtaacattttccaatgaaaggttcaaaatcgcaccttgtcttcactctcctgcaagtatcacaactaaatgtttttcttttctttctaggttttttgttgccattattcttaggactgttcgtttcactgcgctctttggctcttgcactatcctctgggtggtttattatggatctgatactatttcgcacctttccagaagcagaattatatccagcagtcatcggtaaaccatctggtctggggcttactgaggcatttgagtttatatccatttttttccctgatgttcagcaaaccgaaagaaatataaaatacaactgggaaagatgttttaatggtgagtaagcaaaatgtgagtggttttaaccctaaggaagaaccgtatcaaaacactatttttcaattaaatcatctacctaatgagctcattttgttaagatgatctaccataataattattcaaaaactgtcaaaattaaaaggagggtaacagtttcaatagtttaaccagttttggtaatgcctgaaataacataaaaagctgatgctaagtgggctacgctatgctccaggtgaagataatcagaacactacatctctactgcaaatttatatctcataagaactaaataaaatggctagtatttaagttaatcttctaacctaaaaaattatcgagaacaataccgtgaaaactgcataaactgacattttgaaagcatcaataaaaatgttcttcggagcactgttttccatcttctttgaacttccttgactttttgcaccattttttcctttttctttctttccattatcattgtcagtttcctgctttcctagtacattcccctcttcatcaacattcagcattttacttttcataccagatgtgcattcgattttaccgcctcttatgatcgaacgaccggcttttggtgatgtaaattcttcacagtttaattcctcagatgaacttttgatataagcgctaccttttactaactttagctctgggaggtcaattttatcaaagctaccttcaaaatatattgcaccgccaatttgcctcaacttggggaagaaatcaattttggcaagctctgtattgttagcaatcattagacccccttgaatatcggtggcattcgaaaagtttagctttttcagatttttattatctattaaccccaacgttccttgaacttttgccaaaagtggtagttccaagcttgaaaattgattctcgatgaactctagagaactgttcacagaggaaagtttagctagtttaatttctgaaacgtccttaatggtcatattttcaaccgtgtgtaagttgctcaaatcaagttccagctctttggcattagagtggacggttagttgtttagtaacactttctaaacttgcgaataaattttctaaaaacctgttattgttgatattgaaaatatccactttcttgacgttattgaagtaatcgatggaggttaatgcagtatcagatatgataatatttttgatctttttaatatttccgttaatgacaacactacttagaataggcaaaactctccaatcaacggtttcaacttcttttaaagcgggaaagtctaatgatacaaaggaagttaggctatccaattccaactttcccaaagactctaaattataaccctggattctaaaaatgtgtttgttattcttgataataagatctccctctatctctcttattaaccctagatcaataagagatccgctgtagttacttgatatttcaatgtttcctaccactttccaacatttagcttgcagttcaatcaaatttccagcattctcaatatgatacaagccttttttacagtcttcatctacttgtgtttgttttgttggagaaatcacctcaaaatcagtttgttcctttttagggatcgttgcattagtgttaaccaacataatgttgtgatctagaatattcggtccaccattaggttcaactgcagcggatgatttaattaactgcagaaacaagaataaaaatcttaagattgtgttcaactggttcaacatgctatccttttctttttttgtagaaactttggtttctttattgactatttgaataacagaaatactagtgaagaatgtttgtgttttccaaattggcattttcttttatagtctaagtaatgccacaaaatattttttttgagacgcatcaatgacgggacagtaaagacataaacgctcgatcagaaaaaaagaatcgaaaaaaaaagggagaaataagcaggtaaataatcaaaaacacatgactttttactgtttgttatataattcaatatatccatccttcatttattgaagatgaaagagaatggaaaacaaaaactcatgcatatacacacattatatatatatatctatttttttaaacgaatcctttctttattgcttcaattcttagtgagatctcttctataaaaacctcattaaatccaggaacgtttgcctcagttttaatgaattgctttaacatttcatttacgtattttcttgtttcatcgtcgcgcgcacgatcatacattctgttgagaatatgagatacaatgtttttcaagtagtcaaacttttctatcttcaacgcctgaatatcgttctttttatgcttcttattatgattagagagaggaactatttcggtctctgcttgagcatttgggcagcctgaatctatatccattcctgaatcaagctcgaaaactggttgcgtacattttctaaatgatgaagaacttgggttggttatcggcgttacagtttgcccatgaagtaaataaggactttccatatttaaagatgatgttggagagtcttgtgtaatgggagataattcctctttggaaatttgtgttgtgcttagtcttgtcgattcaaaattccaaaattcctttcccctcactgtgttgctgtttttatacaagcgattttgaagagggtatttgggaacttttgtatatctctcctgaacctttttctgtttaattagatcaacatcacttttcaagttcgttatggtgatattcttaacaaattcaaatgataacaagttatatgccgatggccgatcagcaggtgttttaacaagacaaccagctacgaaatcctttgctgcatccgaaaagggaccttgtaattttggaggcttcctttttggtaagttagtcataactttcataggatcatatttagataatgggggtaagcccttgagtaactcataggtggtgatacccaaggaccatatatctgctttctcattatacccatcaacttcgcagcaaacaacttccggagccatccaatacggcgttcctacaaaagtgtcccttttcaaagtggaacgaatgtggccacttactccgaaatcacccaacttaaccataccttcttcatttagtaaaatattagctgctttgatatcacgatgaattttcctttgctcatgcaggtatttcaaacccaaggtgacttcatgaataatgaaggaaactttttcttcaggcaaaccgttgacgtaacttcgcttcagtaaatctgaacatgatccaccgccgcaatattccatgacaatccacatagagacatcttctaacattgttgcaatatagtttgtaataagaggagatttcaattccgccagaaaaaaaatttcctgtgctaacagttcaatgtcttcgtcggaatgctccaggttgaccaccttaattgccacaatttcttgcgtaactctatccactgctttatacacatcaccaaagttacctctgccaatacatgattggatggaatatagcttcgatggaggggttcttgacctaattgatatttctttgctttccattttgtgctattttcttttgttgtttagtaaatgaattagctagtaaaaaaactaaatttaaaaagcaaatgctggtttgctttcttttgagaaatgtttgctaagacaactgactagccaggtgttcactaaatcgataatattgaaaatggcaaaataagaaaaaaaaagaagagaattagctggctttttttggataggaaatattaaatgaagcagttggaaccaagataataaacaaaaacagtatattaagtgactctttagtatatatctgaactaacaagtaaaatatcgatgttagaaatggttacaatagaagaaagtagtgtcattctttcgcgtcaaaaaaaaaaaatggaatttgtgtctttttcgtttttatgtgtcatttttttttatccctgatgccgcattgttccgaacctgggacagctccgaaatataacttgaggaaaaagtattagaaaagggaaaaaaatacagttaaattatcatatatgttattttttgtcctttttggccaattttaaagacttatgcattgttaataagtttgttggggacatcaaattttgagaagacttaggaatggagctcaaactccaccttttacttgctgaggcacttctttcaggtatgttaactctcaaatcgtgtttcttattgtaggacgaagctgaatctacatttgaatgcatatttaaatgcggccctgatcttggacgagaagtatttacagcttggaatgttccgtacatctccaacttagtttcccaatattctaaaacctttggagaccaattcgtagtaatcttcggtaaattatctatatgaataccattgcacaataaaaattctgtaataaaaaaaatgggcgttccatcaacaatttcatagtgctttagggaatattgaaaaatggaagaatggtttagatcattctgctctttttcgcttgccgtcaattctcttagggaatatttactttgggcgatggctctttgcatcatgaaaacactatctaaatggatagctttaattaaagacttcaaagaagcctctctgccttggttgctgtcgataacaaactttttaaattgatacttatcaataatgaatttggatctttccgagtcatcagaatttgcagttatttttttaactggaaagttcctgagattgctttcataaatggcattaacattactattggaaacattattttgtaaaagatgcatcaactctaacgaggtgaaattatccagcgttaaagatctaattttggagatatgtgaacccagagatcgatgaacgcccgaacatttgatacacaatatacacaataaattgattgacacccattctactgttgcggtgctaccgcagtcacaacacttcaaattagatttatcaattttgcgcacgattgatagcagttcgtctctattggaggctcccgcattagcaaaagagaaatgctgtgtatgctgtttggaggaatctgtttttgtaggaatacggttattactattactgttgctactgctactatgaatgggatgagtttgatgattgatgtgatgagaatgcgtagatttgtgttggctcccactaagacgggttgataaatatgtaaatgacagttggggtgaacgaaatggaaatcctgatggtaaagaaggaggtatttgtagtaatatcaatgattctttcgcggccattaataaagcgatgctttttaaaataacacaatatacctcaaaacctcgatcatcctcgcagcggttcgtttgaaatttacatcgaagagatttaagaagaatattagttaactttaacgcgttgttgcaccatgatggatactgtgcttttgatgctgttcttgctactgttcctttactgaacaaaggcacaacatttttgttgatatcagtagtataaaaatccattattgatggaacatccagaaaaatgtattcaaaatgactggtacagctaccttaaccactctgcctcaatgtgatttttatcctctttttcgctcaaatttttacttttcttctctcttcgtcaagtactattataacgacagcgataggaaaaaaaaccaacatcggacgagaataaataatactttagcgttcaaaatgacattcctttaaaattcgatatgaaattttccgcgattaattcgccgagaatacgacaaaaaaaaagataaacatcagaaaattctattattagattagattttatattagataatgaattaatacaggtaataattatagagaggaaataaaaataaacagataagttatttacatcttctaactaatattccattacaagtgaacgaacatgaaaagatcatataaaacccttccaacatattttttttccttctttggtcccttcaaggaaagagcggtctttcttcttgttctataataatattattaaaaaagcacataaaaacttgattgtgtagcgataataaaaaaattttttcgatattataggagtataatgtctctaaactcaaaattaaagaacttagaataagaaagcgacaccggcagcgacggcagcaccgaagacaccagcacccaaagcgttggaagcagcagcaccagtggagatcttggtgctggtggtgttggaaccgttggtacggttggaaccattggtagaaacgttagcagcttggacagcggcaacagtagcgaaggcagcgacgatggtcttgaattgcattgttttgttgatgattagtgttgattgaaacttatgtttaatgatgattttcctctaaaatcaaaaacaatattaactaataaagtaaataatacagtaggagaagatggaaaagaaaatcaagaatttctcgagttccttatatatgaggagaaaagccaggaaaaccaccgcgatgacacacagcaccatatctcatgtaacaaacgtgaaaaaagcgatgattttttttctgctttctttttctcatttctcaagcggatattccgcttgcaaaaagaaaaggcgtggctctggtcttcgctattttggaaataaactttggcgtcctacgcccagaagcggccaaagcggccaatcacgcccgaagacgggaccgcacggctcccaacgagtcgtttttttggaactgaaaaaggcccaacgttgggcctaggcccttaccgcgcccatttcggaaactgcattactttttcgggacgtattctcgggaaataagcaggtccagatccgcgtagcatgaatggggcgccaaaacagtcgcgggtaacgaaagagcgcaaccacgcgtatattccgggccggtgaggggcaacgcgcattgtcccggggcgatataatccatgtaccggaacccgcactttttcgactttctttccccttttcctgtctcctattgtgcgagaaaggtttgattgacaagagatctttactgatcgatcttagttagtcctcgaataagcattttgcaagtaccagtcatcgtattagagaacatacaactttagaattacactatgcacgcccgcgactggtttttagtttttattgcaattttcattcctcccttagcagtctggctaaaaagaggtttttttaccaaggatctgctcattaactttctgttatttttactagggtttttccctggtctgatccatgctttgtacgtgatcagctgtcatccatatgaggagaacgaggcccggtactcacacctctcctcctcggatgataactatggtagtttagcatgagtgactctttctacgttatcctcctccgcagaatttcgtaataagtgatgtgtggctcttttgctaccctttttttttcatttctttcttttttttctattttattttttctttttcatttttcggtacttctatgtacctgaaatgaataataatgtaatggcaagccatctcatcgctgtcggctaagtaaatctatagtttaatatattcattttccctcattcaaagaagataaatcactctgccaccatcgtaatggacttactgggcgatatagtggagaaagatacatctgactctgttgaaagtaatgacaatggcactcttagtaccaacaactgtggaacgggatttcccgagttgtacaaacccaagaaaatatcatcttggaaggaaagactaagagaaaaaagagcccaaaagaaaaaaactagtggcaaggatgctgaaaagcaacaaacgagtacagacgccccactatccgaggcaaaatctatccataatgaaaatattaaagttctgcagggaatgagtgatgaacaaatcgtgcaagaacgtgaggatctgtataactctttagatcccaaactgattgccaagctattgaaaaacataaataaaagagcgaaggacgaaaacaacactccattatttgcagaaatagaaggcgcttctggtacctgggtaggtggcaacaagcaaggcatatacgatctaccaccgttagacgatgaagatgtagacgttgccttagaaattaggcctatgttaggcaaagatgcaaaacatgttcaatttgaagaagcaggaaaagaaaaagacgtggaaggagaaggaaaaactaatgatgacgtcgatgatatcgcacccttagatttccagatggcacaatgcattgatcatatgaaaaatgaagagctattcaaagacgttcattttatcaaagaggagagccaaaatgaaatcaatttagagaaacttgatataaatgatcctaatttcaacgataaattacacgaaaaatacttccctgatttgcccaaagaggtcgacaaattaaaatggatgcaaccggttcagcaaaaaacagacaagaattacatcattgaagacgtatctgaatgtaggtttgactttaatggcgaccttgttccacccacaagacaaatagactctaccattcactcagggttgcaccatcacagcgactcgcctgaactcgccggttacaccatagtggagttagaacatttagcaagatccacttttccttctcaaaggtgcattgctatacaaactttggggagaatactttataagctaggccaaaaaagctactaccagctagtgccagaaatagatgcagacacatacaaggaagacggaagcatatcgaacgttatggataagatctattccatgttttgggacttgattaaagacggaaaagtcatcgaatccttagaaatctcctctgatgagaaattcactagaaatttgtcagtcagaaattatgctattgatgcactttggttatggaaacaaggcggtggggacttccgaaccaagaaatagatagagaaaaaaataatagtacatacaggtgcgccgaccagcgcctattcataaaaacaagaataatgtgtctctttgagtcatgttccttagcttcttttttaaaaaaactgtctcaggtattttcgcttctttgatctcccaatctccatatcccaaccacgttcatatacctcaagccgatttcaaccaaacttgaacgaaaaactcagacaggtctggtaaaatatctgcaatgaagtacgcacaactcaattggtattaattaatatagaacatattaaatgtagaggagagaaaattaaattacatgggaaaccaatcttgaaggtccaataaagtgagatgtgcatggatgaattatccatgcaaaagcaaaaacgaaaaagtcgcaacctcaatcatgccttttctctccaaataacttttagaacaaaagtcaaatataggaaagggaaaatatcattctccaaagcaaacattaagtcactgatcaacagagaacaatggtttatctttgcacattgacacattcatcgagggtttcaaagcacttaaaaagagcatgattcagttcaaaaaaatgatcctcgacaaacttaagttgtgcaattcacatcagcatatccatataaagcttatagtgtgatgatgagtactctcattaactagctctgttattcaaactttaaacttcggatacttgactgctctcttcgtttgtaagtagcttgattgtagttacatcgtcgttctcatcgcatctttttttattagttatgaaaaatttttcacttttcacctagttaggatacccggctggattcttttgtactaacctctatggatttcgtggtcctctcatgtcacgtcaaaatttcagatcatatgtcagggtaacatttatgcactcggagattgtcaaacttattgacgcaagcatttactatttttccgcacaagcaccatgtgtgataacatgcagatcgcccatctgagcagtaatatctagtcattatatagtctatcaaatgttatacttccagaatttttcgcctcggcccaaacatgtacattttcttggtggcttttttattctggctttcttttcctctaacgttcaacatggttgaaaatgctctcaagtcaaataataaaacacaatcataagaattcaaagatgtgcatgagaactcttaacaatacatatttttactgaaacactttggttagcatcttgtgattactttatttatataacctagtcgcccctcccctgtctgtactgttcttgcaggtaaattcaggaaataatacatcctccacgactacaacatgtgcaagtactatccataataggtgtaatcatagagaagcagtcctaaggaaataaaatcaaagaaattaggtaaaggttgggtattgatagatgaaaatgtttttgcaagttaaaaaggaaaatatgcacattctcttataaccaaattcgtctgacatcgatatatcttttcatataaagttcttcccctttaccattcactccatgatgtcgtacctgttacactacagtgcctgcttgattgcgcattcataatggctgtacaccgtttacccaatgcattctcgtctgcaaagagaaggatatacatctttttctggtaataacatgtaccgattaggaaattaagaccctgctttcacgcgtgctcctaccatttccggtaataaaagttcgggtaagatttcttttccaaacgagcttacgtgtcgcatcgacaaatatggcgagtgctcttatataagtaggcaacatctaaaaagaatggacatcttttttttcagtgtgaagacgttatcgtgtgagtattaataaagagttgtaatttgataataagataaccaaggagtaaatatataaagttcaccactgctctgttatctcttttttatagagttcggaaatcctcacagattataaccaactaatcgtcattcatttcaaaaaaaaaaaaaaaggaagaattagagctcttccacaatagtggctattccaggcataatttcaaatcaagtggcaattttacgctcctcattcattttcctgtattatactttaattattcttatttcgctttttttctcaaggtgacctgttgtatcacgttagctgaaatggaaaacttatgccctccacctccttcccaaatgaaggatttttccactcctccaagaaacaggcatcgtcacaaaagatcctttgctatatctggagattttgaattcttaaaacaacctgcctctgcgcctgttttgccttctgcgtacgactcacctaccttcgaaaatacaccaagaagagtaagcggtatgagcgtaacaatgcctgatgaatctcaaaatgaatcagcattactaaactcaccaagcccaaggttttttattagcgaagcatccacatattcatcaccaattaaaggagtgccggacgctatcattaatttggatgatgtgctcattaataaaccaaaaatgtgtagatcacatcgcaaaaccaaatcagtaccagtaaaattggacgaattttattcctcccataaatgtagctcagtaccagaattaactataaatgaagaaatagatgaagatgacaccaaccctcagttgctggagcccgtaaaaccattatcatcaacttctctatctactgatatgaatgaagataaaaaaatgacactaaaaaatgccaggagccataactcgttaaaaattcaggcacaaaagcaaaggtactacaactcagcaaggtatctgcctttgaatagtgaggaccgagcaacagatccacaaattttaacgaagcaaagctctgttacgtctttattttcttctaggtcaattacacctgtatcttgtaacattaacaatgcgggtagaatcaatgcaatcagtggtaattatctagatgacgtcctttatgaccttgacacccctgccacaactctaattcaggatattgataaccttcaaactagtatcaacgaaagggttaggttgtcaccacaatcctcgtcgataaaaaagtatttttccaaagatggaaaatctgttagcagcttcaatttccagtctcaggagtgcgatatggtatcttttactgaggattttgcccatgtaacatcattgtcttcttctattcttgactctgagaaacaaacagacgacgaagaagaagagagtattccggaagaaatactacgaggagaacccctccacgtatacaacgaaactagtggatctgataaaagtgtcattttgccgacgaaacaaaaatctgctcccattaacaaggatagtaagcacagttcaactcagtatgaagaaaaatcttttaagaagaatagaaagttcaaaattttcgccaagttattctgcactaggaaatagtagaataaatttaagatatatagaccactcgataccccatcacctgcataattatagaaaaaataaatactaatagatacccgatttataacactagacattacaatatacgaatttcataataaaattttaagttcagactatagataaataaataatatgaagtaaacgtttcaagcaaacgcttatatatatatagagagataataaaggatatgatttagtctctgtcccttctttcaaatgaatatttaatgccttttttttttcgggttgtgtgttcgtggtgatttttttattcttcttttcatttggagacctctatgttgtctaactcgtccttctccttagctgcagcttcagcttctaatatgtatggcaacaggtaaggaacatcctcttgggctttgatccattcgtttcttggcagtaaatgatgagtcaactcggtttgatgagccctgattattctatatgctctggcataagattcatcttcagggagtcttcttaaagcggtctgcatgatgggattttcctctgcaattaagtcgtcaaatttgagccctaacttcttgtaacctgcgaggttaatgaactgattggcaactggaacacataacttggagaggacgggtgacttcaaaatatagtcaccaattctcgcaatagacgtaaaagactgtggcattttgttctttctggaacgtttaattacagttactaatattctgataaattgtccaacaacaacctttactgctatttttccaagcttttacatctcttcccttttattactgctctatgaaagtaaattgtcaggccccccgccggggtgacccgataaaaagcgcgtcgctcctgattggtcaaaacaagatcacagcgcagttacacatctatagacaatgtacatatggctaatagaccttaatagtgatactctgttggtttttggcctgctgtgttggggaaaccgcattgcagtaacgacttgtccacaagatgaggatcttcagtgaggttctctagtttttctctgtctttaacgaggatcataccacagtaccccgtggagttaatgtttaacatcaatggcggtccactcttggcatgcgatcttggaactacacagatccatttcttggtcagtagcacattgtatgacttggtcaactccggagactcattggtccaatcttggaaaaatgtaagtgctctctgcatcaaagatacgtaacacatagcaagaagatcttcgtccacttgatcagacgattccggcagcggcaagacgaaatgagcaaaggaaaccttatcatcttgtaatggctctgcgttgaaggtgggcaagaaatgatcctttccgttgcacaatacgtcctgaaaaggtataaatttttcaggcatttgcatgatctgcaagtgtttgtgatcttgtgaggaaccgctatgaggtccacaattataaaagaccagatacctttcacaagtgacatcatcgtccttgtctccttggagagaacagagcacattataagcagtcatcaagtcacttggcgtcaaagcagatctctggtctttaaactcgcttgtcactaggagactatgttcagggaccacaggaaatttgttgagtagcagcttatattctccgtcaccatttagatcttcagtcaccactagttcttcgtcgggattggcgaacgggtcctccgcctttgaatcgctattcttgttagcgtctggcttaagtgccaaagatggagcaaatgtcacccaatattgtgtcgtcgtttgaggatctttcaacttcttggattctgcatgcgttactttcagatgcccattctttttggctgcaacgaacttatcgtggattttctgtttcaaattctcttcaatcatctttgtcttcctattttctctgacccaggggctcggttgccttttaattttattatatttcaatagttcaacacattttcgaaacaggcaaaagctttacacgtgacgttggtatgatcgagtattattcatatggtcgttcatgattgcgtatttacgacagtatctcaaaaagtttcactcaaatgcggagaactatccgcgatctacgcattgagctcctttagtttgtaattgccgggaccgatttttttttttttacttctgactgttccacttaggaatcttacatgacgttaaacgactagcgcagttcccccaatatcggccgaaattttatttcaccaacataacgatgagtaaaaagaacttatgtttctgaacagattgatcattaaaactaaaaaactaccagaataaagaaatttatagttccaattgagtgcatgcgaaaagaatcgcaatgccgcgaattactcaagagatatcttacaattgcgattatggcgacaatactttcaaccttgctattgatataggaggcactctggctaaagtagtcttctcgcctatacacagtaacaggctgatgttctacaccattgaaacagagaaaattgacaagttcatggaacttctgcattctattatcaaagaacataacaatggatgctatagaatgactcatataattgccactggtggtggcgccttcaagttttatgatttgttgtatgaaaattttcctcaaataaaaggtatatcgaggttcgaagaaatggaaggcttaattcacggtttagactttttcattcatgagattcccgatgaagttttcacttacaacgatcaagatggcgaaaggataatacccaccagttccggcaccatggactcaaaggctatctacccataccttctagtcaatatagggtcgggtgtctcaatattaaaagtcaccgaaccaaacaattttagtagagtaggcggttcttcactgggaggaggaactctttggggcctattatcactaattactggcgctcaaacttatgatcagatgctcgattgggcacaagagggtgacaattctagcgttgatatgctagttggagatatttatggaacagactataataaaattggtctaaagtcgtcagctattgcaagttcatttggtaaagttttccaaaatagaatgacatctaacaaatctttggaaaacaacgaaaataaattatattcctcacatgagtctattgagaaaaacaatggacaaatgtttaagaatcctgatatttgtaaaagtcttctattcgccatctccaacaatattgggcaaatagcttatttgcaagctaaaatcaataatatacagaatatatactttggcggatcttataccagaggacatttgactaccatgaacactttgagctacgctattaatttttggtcacaaggatcaaagcaagcgttttttctcaaacatgaaggctatttgggtgcaatgggtgctttcctaagcgcgtctcgtcattcatctactaagaaaacaagtacgtagatagatttcactttttttttggctagtaatattacatacatctttatctagataattaatttattcgtttgttagctcgcttataatgtcatccattacctcaaagatttgcaccttagtattatttctgtacttattgttaaatttactgctcgcttcaatgtctgtgactatattgccacccgctttttgtaaaatagtaatgtcttttatcattggcctttttaaatcgcttaaagatatggcaattatatattgcatatcctttatttcaaattgtacttttccaagctgggtaaagatttcaaaatttaatatagtcgtctttgaccctttgagtaaaaagtgcttttcccaaaattttgttagcaaattaattgactgacataattctgattcattggccattaaatgtccagaatcctctttttttgattgctctccttttcgtattatttgatttttaacttcatgcatttccttgagctctttcgttaacctttgattttgcttctgcaaaaatagtagtttttgccaattcgtgtatgtctcttccacaaaatcatctgaatcacttgaatttaatatcgtatctttttctcccatcatattcttatcttctttgtttgttaaattttttagttcattgagcgaatcccaacaattttcaatatcaccagtggcttccagatacaactcatttattaaatcttgcctttctgcaaagttgtgaccggtctcttggatttcagctttgatttgttctattttgctttcttgaacattcgaaatttcttcctttaaatcattaactctttcattaagttttacaaattgggggtctttttcggaatctaactgcaaaggtttcgtcgaggacaaagtaaacctgaagaaatagtccaatgtctcctgttccaagtaagtcaacttaagtaactccattagtttattgaactccttgatttttgcactcagaatttttggatttacaaagacctcctttccctctacgtctaagctctcatcgttcctaagaggattcacaaacttgttctcttcatttattgccagaatgctggaagtaatttcgtgcaatgtatttttgagccttagttcttggttatttagcacttcttcgctgctcacagcaatagaatcctcaatatccgttaacacggtctcatagtcctttatgctcgcactccctgtatccatttcttcactaattttgttttaaagctagtctatatgtttttttctattggttgaagtttttttgatgctgctcattctccttgtgtttataaataatgagttacgcgatcttcactttttttacatgtgcttatatttaactgcctagttcccaagcgatggcattaaagacagccaaatgctaatttctggttgaataacctaatacgtatgccctaaattatttttcctttttaatctggaagatattgtttatccggatgatataacgttcaatttaattgatgggcattactaaatattttcaatatgaccaattcgtgtcgacattctgccataattaacctgagaaaaaaacatttttcgtgatcatttagcaagaaaccgcaaggaacagctcactaagatgcaaataaccattagataactgaaacacacctacaatgtcccacatgaataaaccctttaggaagcatcggcagctgacagaaataccaaaatgaaaaaaaaaaaatttagaaagttttatgtatagttttacatattgcatagatgatttgcagcgtaacgacgctaatgctttcttctccattctcattgatattaacgttggctagataaatgctgtgcaacggagtggctgaaaaataaattgtagcaccttgttggagaccaaatgtagtcttcactattaacctctagctaaagcagataaaagataaagattataaactttggttattggaagacccatctcagacatgtgtttccccaatatccaaatatttcaacgtattaacaatgaggtacatccctcgtactcaataacgcctcctaaagttccttacatctatatagtagtacaaaggaaattctaattatcaacctttggctcagttttttaaagcgtcgatggatcttacggcagtggagtgcgcagaagcaggattcacacctgttaccagtcttccgtcagtaatagagtaatcatcccagggcccaaccggagctaaatacttagcgccatattttttagcaacatcttcaacggttgccaaattcttggctttcaaaatactatcaacacccaaaatggtttcaccaacatcagtaaaaccggtgatagatttaccttcgatcaatggtcttcctgtttttttgtctgttaacccatcaaaaatagcaggaccgtgacaaacagctgcgacaacaccaccgttagcataaatttcggaagcaatgtcctgcaagtctttagccttaggatagtcaaataaggtaccgtggcctgcagatgcaaaaaaaatttggtaatcatcggcattcacctcttttggtgtcttaattttagccaatgtcttgttgaaatctgagtctttatttttaaaatccgtttcgtcttgaccatttagaaaatctttggctaaggaatgctcatcccaaccaaattttccggtttcagatacaaaatcgacttcaaaaccttcttttcggaatgtgttgaagggatgtaaggcttctacaacaaaaacaccggtcttggcgccgtcactgtagaatacatcgttatatgaggtaagagcgagtaaaactttttttggggccattataaatttgtttgagttttatctgtgtaattagccagtgggaagtacttaaaaatgccgttaataaaatttagcggatgataaagaaatgaatggttctccttatggctgtttatatatctgatttaaagggtaacggaaaccggaagcaataatggaaccgtgaagccatcccttgaaaaaattttccatttctttcatgaagactatgtacatgccccttatgccaagctttttgattttcaggctaggaatgagtaacgttaattctctgtatacattcgcccagatttctttacgggatttatggatccgtcagaacaaaaagccgcctcccatggatatcctgcgtattagtcagcattatttcttttattccgtagcagctaaaaaatctcctagaaagaacgatcctatctgtcgcaacggtacgtcgtgatttttttatgggcttattcttccgaaagtgttcattaaagcatttggtgcatgtttaatgttctatttttaatacacgtagtaaacttcgtgttttcttctctctgacctaaattattacagccatatataactttttttttaaattcggataactggcacagtaccaaaagctaaaatttctcacaaaaacataattatatgacaaactgaactactcattgctacaggtaatttcaataaaatgcgctcaatgaagttgtgaatttgcttgcttgtctttctcgaccttctttcagtattatactccatttgaatctgatcacaaacacgaaagttcatttcttgttttgaactataaaatcatcatgtcattttttaacttttattttccttggcgtcagataaaacaaatacccactctcaccttttaaaaagcaagaaataaataaaatggttatttttgaaaagtcatatttaacaagtgaaatagacattgtttttagattattttaatcaacacctgatattttcttgatataatattacatactggtacattcttatagacagccagtgtcacgcagacaaataacattgcggacataagctttatcaactatgatgaaatacttaattcacaatgccattttgaaaagtaagaccacggagagatcagaaaggttgattctgcgcatctgtcgttagcagaaattacaaaaagataacggcagcgagcgcagcgcccatcagacccgtaccagcggcgatagaatcagccgcacccgtgtaattcacgatttgaggagttgtggacgacttaccgttagtgaaaataccagcggtagtggtttgaactcttgtaatagaggataccatttttgtgcttgcagaagaacttgatgaccaattgttactttcatgggtacgaacagattgggcatccctagaagaactctctgtgtaagcttgcccaattctagtaggagtaacaatagtagcgcttgactcagaggaggtggtagtagatgctacaactgcagacgtggatttagaattagaggaattttcagtagtagtagaagaaaaagttggcacaacagaagaggtttttgcagcagaagaagtctcaataggagaagaagcctggacagaagatgaaagagaagtctgagtaggagataagcttttaacagaagtggtctcgatagtagaggaagaagaagaagtctcaacagcagaagtctcaacagcagaagaaatctcaacagcagaggaagtctcaacggcagaggaagtctcagcagcagaggaagtctcagcagcagaagaagtctcaacagcagaggaagtctcaacagcagaggaagtctcaacagcagaggaagtctcagcagcagaggaagtctcaacagcagaagaagcctccacaatagaggcctcagtagtggagggaatttcaatagcagaaatactagaagttgcaacggtggaggcaggagcgcgttcaccctcaccagtccatacgaaagtagcgtcctgggtgacggtctttgtgtagacatgtccatttttggtggctgtaatagtggtagttatactcgaaccagatccttcatcagtagaggcagaaggttcagcaacagatgttactggagaagcagctgtttcgacagtagcaacggttgagacaggagcacgttcaccctcaccagtccatacgaaagtagcgtcctgggtgacggtctttgtgtagacatgtccatttttggtggctgtaatagtggtggttatactcgaaccagacccttcatcagcagaggtgccctgagcagaggtagaaggttcagcaacagatgtttcagcggcaacagatgtttcgacagtagcaacagttgaggcaggagcacgttcaccctctccagtccatacgaaagtagcatcctgggtgacggtctttgtgtagacatgtccatttttggtggctgtaatagtggtggttatactcgaaccagacccttcatcagcagaggtgccctgagcagaagtggaaggctcaacaatagatgtttcagcggcaacagatgtttcagcggcagcagacgttgcagcgacagtagacgcttcagttactgcggaggttaccgcagcgccttctcctgcccagacaaaagtagcatcttgagtgacagtcttggtgtaaacatgcccatttttggtagcagttatcgtagtagtaatactttcgcctaaagcggcaacggtgatagcagataatacaaaagcggaagacaatttcattttcgggtattgtattgttattactattattattcaggcgaacaaaaggactttctgaaaataaacacggcattaggaatatagaaaagttagataatcattagtttaaatagtgcaaaaacttcacttcaaaaatggtatacgagtgtcatattatattagatattcatttttttgcaccctttcctagaactcgcgtattgagccctgaggtgtctgtcattacattatgccaaatgtgcgacagcgcggtttggaacaaacagggtgcggaacagggtgcacggcatagttaaaaatggaagttttggtgggttgtttaaactctgattgtaattggcgaccattcactgcttatttcgtttatctggtaattgtcaacatggtaatgaccatcaaaacagtaaacccgatactcgaaaaagtgctcagcgcgatcactgtcgtctggccaataacattttataataaaatacgtttttcctgaaagtatcaattagaaatagcgatgcataaaccgattaatgtgagatcctaatactgttccatttgttagtcttttttccacaattgctcctctttttttcctttcaaaacttatagaaaagttcttgatgattaaataatcagtaaaaaaatactgcccaataagttcaaagcgatcacgaatattttaagaacatatgggaagaagatggcacagattaacgatcgttaacaaattatgtaccatagaagtatcaattcttccagtgttgcactttaatggaaatataaggattaaaataatgtttctccattgactaccaaataatttttctccattggctaccaaataatctttctccattggctaccaaataatctttcttcattgactaccaaataatcgataagataaaatagcacgaagcgatatgaaaatacacagtcggctaaaaatttgtgggtaatttaccttcttgatgcatcaaaaatcgactttttaagagttaataatcattaaccttattctgacgaaaatagcagcgtatttaactctattgtacaaacataattttcttcttattgcgttagagtttcctttgctatggatcaatgaaattgcagattacgaaagaatcaaaagaaataaaatcggaaatcatgacatgtgctatggcctgtgtttccaggtgtaaaagataaagcagaactaaccaagttcattagaaaagtacaataccaaatggaaagaaaaaggaattgttcttctaagctaatcggcaaccgcttataaagtctaccccattcagtaagatcgaatatcttggaggtcatatatgttcattcatcggtgagtgaggataatagtggcttttgtaaaaatttttattatggtgctaatacaccatactatttctgaggcaacaccaaagaagggtccgagagttcttaggcagtaaaaaagttacacagcctcagaagacagggatcatgcagtaaaaaaaaaagctcgataatttcatcgatcaattgaccagccaatttattcttatacccttatttctaccgatataaacagttggataaacggacaggttgaagtgcaacgttattcaatggtgacagttgcttctggactaagaaaggctagaccatgtgccagaagtgcagaaaaatgaaagcagagagcaaataaaaaaactcgacaaacatcggaatatcaaccagacaatagcaagtggacacaatgaaataaaaatctcacaggcaaaaacgcacttaaggtgacgtagatgcgtccatcatttaaacacgataccaacattatctgatgtttcaatgttgaaaactgacattcaaatattccgcaaccagcggacgaactgaaggagcaggcgactacaatgcgcagggcgattggcgcggtaactttgccatgatcaaatatttgtgtagcgctttgttcactatcgaactttctaaatgagttaaggaagagaagaaaaacaatatgataccgcaaatacgtattctcacctaaaatggcaaggcaaagcttcgccgaggaattcagcccgagagtagaaaatttactaatgtggtctcgcgtgtgaatcagcaatgattctgaaatactccttttacaacctttgcaaagataatgtctttcagtctgatattacgagcgacctagaaccactaatccatattcttcattcaacttactccattttccttggcaaacaatgccccacaatcatatacgtcataactataagggatatgtctggaatgcggccaagatagaattaaagggctgcagaacaccactactgatactcattgccaaggctaggaggcaccatccgtttcattttctttgaggtaagccaatcatgaaatagtatacacatccataacggacgtacggacgaaataagtgccgttgtcccactattccaccgcatttggcccatttggctcactttgactcaacttgcgtcattttaactgatatgaagggtccgactttgtcctttttcggccaccgcataccccacggcgatgcctccgctacctgcatttgagtagcatctccgtttcgcggggtattcggcgctacgtcgcctgttcgagcggctctgttcgttgcatgaaactaaaataagcggaaagtgtccagccatccactacgtcagaaagaaataatggttgtacactgtttctcggctatataccgtttttggttggttaatcctcgccaggtgcagctattgcgcttggctgcttcgcgatagtagtaatctgagaaagtgcagatcccggtaagggaaacacttttggttcacctttgatagggctttcattggggcattcgtaacaaaaaggaagtagatagagaaattgagaaagcttaagtgagatgttttagcttcaattttgtccccttcaacgctgcttggccttagagggtcagaattgcagttcaggagtagtcacactcatagtatataaacaagccctttattgattttgaataattattttgtatacgtgttctagcatacaagttagaataaataaaaaatagaaaaatagaacatagaaagttttagaccatgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttgattcacacacaactcacaaatcatattttgtaatttacttaagaaagcattttgcggggtttatatttgttccttgccgcaccaataatattcatatattactacataactttagtattttaacaccagacgatctgtcttttgaggaaatatgtccactttcattttcttccgcttgccgcaatgcctataaaaagcttataaaatagcccgactccgtagtcttaatatttatttaagtacaataatagtcccacaaaaatttttaaaacatctttattgataacgtggacgtgttattacattggagcgaatgatgacggaagtaggaaaatctgaatactaaggtgaagatattttagcagggtgccgccatggatgttctatgaatgtcttccttccttttctctcatgggacaccgcaaaaacctgttctaccatcatttaactgcaacatacaaaaagccaccaactttcgaacactgcaaatggtgctattctctttttgcggtcttgccatgatattcttcttgcaaaaagggttttagagcaagatttcaaattagccatgaatatcatgcatcgcttagagcagtaagattttaccagagctttacaggacctatttttcatacgttatgcacttcattcttcttgtcggtttgataacagcagaatctagttcctttaatttgaacgttagcccggcagaagccatacctcgaaaacgcagcagcgcttcataggcatatcaaaaacagggcaagggacaccatacatcacctagtgctgttacttataaccaacttgacaacgattgcacaagaaaagagtatatctgtgaagacagccaaaacgcttaacatgttatgacataaattgcagacaagaaattggatgtattttacagactttgcattcctgtctgaaagcctttttacataaaaatggtttcattagtagcacttcgtatcgttttcaaataatgatgagatgctccaaaaggaaagttggcacagaaaaaatgacgcgcctttcctgtttaccgttaaacttctcagaaaaagtatactcgacccatttttaagattggtgatggatagaatttcatttaacataatgctgcaaatatagattgatttcaatctacggagtccaacgcattgagcagcttcaattgagtagatatgctcctatttccaagaagaactaatatagcctttttcaaaacaacaggcatttttgctaattttcctttgctaggtagaaccattacaacttcaccatctttccttacacataaactgtcaaaggaagtaaccagggcatcaacttcgcctccaagaccaaagagaattgttgtcgcaattactggtgcgactggtgttgcactgggaatcagacttctacaagtgctaaaagagttgagcgtagaaacccatttggtgatttcaaaatggggtgcagcaacaatgaaatatgaaacagattgggaaccgcatgacgtggcggccttggcaaccaagacatactctgttcgtgatgtttctgcatgcatttcgtccggatctttccagcatgatggtatgattgttgtgccctgttccatgaaatcactagctgctattagaatcggttttacagaggatttaattacaagagctgccgatgtttcgattaaagagaatcgtaagttactactggttactcgggaaacccctttatcttccatccatcttgaaaacatgttgtctttatgcagggcaggtgttataatttttcctccggtacctgcgttttatacaagacccaagagccttcatgacctattagaacaaagtgttggcaggatcctagactgctttggcatccacgctgacacttttcctcgttgggaaggaataaaaagcaagtaacactttttctgagcattttattacgttactcaactactaatagagttgatttgttacttgctaaaatctttttatatttcttttagccccgacagaacttgttgcaaatgaatacaaaccgtgaacttcccgatatcattctaattgaacccagatatttacacatgtacttcttactcattttcaatgtcagcttaaatatcgtctaaaacaatattttactagatacgcagttcaatcttcgcgcatattttcacgaaagtccaaattgcgtacgtagttttatgtcaaagtgaccgccgttgtagcgtactttttcctataagacaagctcgtgatatcaggaatatatcaggaatgtaaacgaataccgcatatctttttgatttttttcctctgagttattctattcttgacattattacatcaccaattcaaaagaattgtcaatttatatatttaaatgaggaagctaaatccagctttagaatttagagactttatccaggtcttaaaagatgaagatgacttaatcgaaattaccgaagagattgatccaaatctcgaagtaggtgcaattatgaggaaggcctatgaatcccacttaccagccccgttatttaaaaatctcaaaggtgcttcgaaggatcttttcagcattttaggttgcccagccggtttgagaagtaaggagaaaggagatcatggtagaattgcccatcatctggggctcgacccaaaaacaactatcaaggaaatcatagattatttgctggagtgtaaggagaaggaacctctccccccaatcactgttcctgtgtcatctgcaccttgtaaaacacatatactttctgaagaaaaaatacatctacaaagcctgccaacaccatatctacatgtttcagacggtggcaagtacttacaaacgtacggaatgtggattcttcaaactccagataaaaaatggactaattggtcaattgctagaggtatggttgtagatgacaagcatatcactggtctggtaattaaaccacaacatattagacaaattgctgactcttgggcagcaattggaaaagcaaatgaaattcctttcgcgttatgttttggcgttcccccagcagctattttagttagttccatgccaattcctgaaggtgtttctgaatcggattatgttggcgcaatcttgggtgagtcggttccagtagtaaaatgtgagaccaacgatttaatggttcctgcaacgagtgagatggtatttgagggtactttgtccttaacagatacacatctggaaggcccatttggtgagatgcatggatatgttttcaaaagccaaggtcatccttgtccattgtacactgtcaaggctatgagttacagagacaatgctattctacctgtttcgaaccccggtctttgtacggatgagacacataccttgattggttcactagtggctactgaggccaaggagctggctattgaatctggcttgccaattctggatgcctttatgccttatgaggctcaggctctttggcttatcttaaaggtggatttgaaagggctgcaagcattgaagacaacgcctgaagaattttgtaagaaggtaggtgatatttactttaggacaaaagttggttttatagtccatgaaataattttggtggcagatgatatcgacatatttaacttcaaagaagtcatctgggcctacgttacaagacatacacctgttgcagatcagatggcttttgatgatgtcacttcttttcctttggctccctttgtttcgcagtcatccagaagtaagactatgaaaggtggaaagtgcgttactaattgcatatttagacagcaatatgagcgcagttttgactacataacttgtaattttgaaaagggatatccaaaaggattagttgacaaagtaaatgaaaattggaaaaggtacggatataaataattgccatagactttctacggaagaaaaaccatataatcagattttaaataaaattttccgaacttttatactccacggttttggagttgtttgattgcagtgacaagcagtgcgccattaacactatccatctttcgtacaaagtaaagataaagttattttcctgaggtgagaaccgtaaatctttatagacaaggagtatttataactaaactattaccttgttacttatggaattaatcttgactaataggcagatgatcaacagttattgattttgagtgaaagtccataaagttacagtatgtaattacagtacgtaattaaggaatgtctgtaaatatatgctcctttttttttttccacttactatgattttagtaaagcaccatgatgatgtagatgcgtaatactctataaatgtaacatcgttaaagcattggttattttaatttcattctataaaccaatatttctgacagcacataaaaaataaatggactatattaacagcaaatatcggttaatctagggcataattatttaacatcaaaaagaaagttgctagttgttctagtattgctcggagtacctcaaacggtaaaaagataatatttgtttccgcttttatcattgaatagcttagaaattctctccctagcgaccatttaaggaatgtagctaacaaaaatgattcaagtatgttgctcctaagcagatatgtactctataagttgaatcactatatcattgaaatatagtggcgagggcgtacataaaatcaaaggaactatgcaatagactcaattaaatgccacatagctatttaagactccaaatctccaatacaatcattcgttaaagattttttgtattctgctgatatctttttctacagtttcttgagtgtctagtgattgcataaaatgaccacagtatttttagtactcatggcctgtatgcaattgcaaggaacggtattacttttacaaaaaccctgctttccggcaagttcagctgtcatttggtaagattttgaaaatagtggaaacaatggattatcaacgaatagtctttaaacataagtgctaaaattcaaaacatcatttgatgcgtgcggtgcattttttcgtgctgaatgaacttttggagatatctgccttcgccaatgaatatgcattaccattaattgcatagtaaccgtatacatgaaaatggaaataatgaactgattattaaaaatagctaatgcaggtgggatttgagacattgtggttatcctgtcagcctgtattttgcgctttaaggtatttcataaaagttagaataaaatttaaaagttccattctatgaaactgtaattataggtatatactatcatctaccaatcttacccatgtatagttctaatattaaagacagagtaggtaaaaaaaaaaatggtaatcaaaacgtgatcgcttatattcggtatggacaagctttgaatattccctagaaaatgcaatagtatgtcataatgaaagaagattgtaatacaatgcttggaatgtcgaccggcagaaacccgtgtcacatggccttattcaacgtgacgttgtgatatatgtagaacatgctttagatgaggcggtatttgactgtagcatcttctaaaatgtgctgatattgttaaatctcaatcaaactgagagagtatgagagactgaaaaagtgggattctgcctgtggtgctaatatccttaaaatgctaaactgaaagaagtaatataatcatatatattgatcatgtatcatacaaaagatgcatgtattttagtaatattaactgctactatgatgtagtagacgatcgataatcgaatcttgcggtatattctaggatccttcatgttgagttaatcggttatacttctgtcgctgtggcaaactgatgtatgcgccaacttgagaccattgtctccacattacagaggtgcttctaagtcatctgtttctaaacactttagctttctataatattctcttctagcgactttcctttattgtcctattatataaagcaatcatacacggaaatgtaaacccaggtcgctagagtgtgtataaaggaagattattttgaaaattatgaaagttttctagatgtctgttttctttatgcaggatattaaatacaagtttgtgcttaagaaatttccatgaagatatcaacatttattgtaggaattgcataaatagatgaattatgtgccgctggacgtttatagatagcataagcacaatgacttaaaggttataatactcattgatatcactctgattataaaatcgtaatatgcgaataggtgaactaatcggaataacccatacgacacttcaagcttcaattctatttcaactgtagtgcctgctagtgaagaatacaaaagtagcatacgtgatgtgcaaaaaatgcgctacttatcacacaagtaccttgcgcaagaagggtactctaaaccggggccatcgcattaccagacggagatgtattctttatgaagcaataattggaggtgtatcaagttcgaaactgctgatgctatggatttacatctttcttatgcacaaggcttgcttgtgtttctgagtagttagtttttagatttttgtcaagtctggggtaagttaattcgagcaaaattaacggcacgttattctaatgcatatgttgttcatatattcttttacaaagaggtttggaatgatgtcaccgatgttagaatgttaggagaatttcatgtgaattttagtccaagtgttgaagttctcttctgcagttagggcacgtacatggcaacgatatcgtttttgatgtattaatcttagtaggcgttgagtttgtatgttacttttctcaggtgatgaagcgtgatgacgatgacaaaaatgggttataatagggcgcactatcatcatgcgtgattgatatttaaccaatgtcttgagtacatcaactccagaaaatgggtcattatatgcctagcatgtattatttgagacataaagttttatctcgagaccttgacgtataggaaagatcttaatcaagtgacattactttaaaatttaaagtatgtgccatgtataccatatacgatagcagaatgtgacacaagctataccatacgtctctgatcgacattcatgtatggtatcgtctatatcttgtgcttaaaggtagcgtatagtaaggtaattactatatgatcaatactgtgtgtgtagagtacaataaaatatatgggaagaacataaaaagttcgtattgtgacatgttattgaggctatggtaagcgtaagagagttttgtctttatactgctgtacattatatgaggttttgttaaattgactcataataatcgagattcatttctcaaatataataatatcaaaaaatatgatattaaaaaaggttttcctgtggtagtttctaaatcctgcaagaaaaaaaatagacggccatatacaactttctcattatatcttcctcctttttatgcgttgttcttcaggcactagtctcttccattttctaatttttcctctaaagtttgtgaaaggagcaaccgtgttgatatggatccatttatacacaggccacatagctttagttgtagcccattttctatttcccgcttgaaagagctcatcatcagataaagtagatatccatttatagacctcgtttacggcctctctcagcttggctctttgctccttaatggagtagattccgtattttttataaaatgactggtataatcctcctaaattgttccatttataaccaggcgcaggagtttccacattatacccagcaatttcctttgcttcccactctaataataaattaacccagcccaattgataagagaggttttcagagggtgttctatccactgtttcaactttttcgtctttttgagattcagagattgtttcaaattctgcatcatatttttcatattttttttcaatctcttcctttagttcttttttactggtatattctctcatgatagttttttttttttcaattgttattatttaattcgtttaattaccaatctatagcgatgtaagtctcactattagccgctattagatttttttccatttgccaatattgatttttaatcgcattcattatttgatcaaatttatattagtatgtacacactcaaataaaagaaaatagggaaaaaaaatttgcctgcttcaattaggcttttggtacctgatatccgctcgagattaagtgcggccctctccacccgataaggaacaaagggcatgcttccttttttagctttacgcactattgtcaaattgtttatataaacaggctgatatagaattcatcctgaaaacaatggtaaagtttttcttattgcacttcgctatcctaaattcagggttgagatttctttctctttatgaattaatgtacgatacgcttcagcctttcggcagtgcatacatatcctagcgcgctgatagttggccacgtcactttcttgcgctccgtagcatcattgttctttgacgtaagaacgcaaactctggcattatggaatgcataccggtatctgataataaaaatcttggatactttcctacaggccatccggaatcatgtcagcacaagaaacaaccatattccactactgaggttcttatgatagtaccatatacttacagcgttagacgataacaacaaatataatattaattgagcaaagttctttactgtcattcaaatcggtgagtaagagtaaaaattgacaatgaaataacatctatgaatgaaatcaagggaagtttctgaagtaaaaattgaccattattcactactagtagtcgcgttattaagataatatactgaatggagttaaagatgagataaatgatgagaaacagtctgcgagtataatggaacatgaagcgcaagggctgattttgtaataagataatgaatgaaaacgtgtaaaacagataaagaaataaaacagattaatgtgtagaattatcgattcccttttatggatctctatgtccccgaggagcacttctagtgtattctgtataagtaataatattatctcaagcaataatgaattcccaataattatctcaaaatccactcactcataataattatatatgacgcatttaatttcagctctatgtgcataacattaaaatggaagatcaaaaattacactcttcacacataagtgcaaaatatagaatcatttaagcaatattgcatcctgcatatgattctgcgtttttttttttttcattttgagcagaggagattgagcaaggatttacgcttgcacaaagtatccttgacttgaaaaggaagttaaaatcgcatgagaaatgcaataactttatcggtacgccatataacatatgaacattttttagtaatattatagaagaggtgattgaaacgagatagtacgcgtagcaaaacaatggtaactagtgagatacattaccaaattatccctgtactcttgtgatttcgcatcaatttttccatatgttgaattacagaattccaaaggcaggatctctgatctactgttttctataatttctttgattccatctgatattacgcctaaaaagtataagtctttcaacgacttatacttcataattacataatacggttacacatataggtatcttaaattgatcacaagagtgatccaagtaagtgtggagtacctttatcaccattcactgaatattagtatatttagatgcacgaaatgggtactttttaaataccaagcatttacgatttccattttttttattttctataaaaagattttatcatggttagtctgaagagtcaatggtactacaaaaatttataaagaggttcgaaaaggcttgatatgccagcatacactaaatatgacttatggtttcccttgattattttggcttcacataattgcgagattatgtgtggtatggcgtcataatctgttctccttcttcaaaatttgggcagcagtatcatggacactttcgtgtaaacttctgaactcaaagccaagtattttcctcgttgcactattatctgtagttgaaccgcggtcaatgacttgatcacctgtgccaggcttacccaaaggaatgagacctcttaattgtggaaaatcttcgttcaaaatatccaggatatcttggtttccaaatttaccgttagttaccactaatcttttacccgcggtattttccttctggaaagcatacagatgagctagggccacatcccttacatcaataaaaatggaatgaaaatcaggaacactggcatttactggggtatgaattaggccattgatcatttcgcaagaagtattcaaatggccatgcacatcttcatcgaaaagttgaggaccaaaaagaagagaagggttgactgttgttagtttgaatttgatgtgatcttcattctcttttgtgaactcccaggcagccttttcagcaaacttcttggatgcaaagtaagcatttatcccatcaatttgacagctttcccaggttgcttcgttccaactctcttctgtaaaaaccacactgggatcgtccatctttgcaagggttataatagcagtacaagaagaagtcacaacaacacgctctacagtgtctgctgcatatttcttgatagaatttaggatgttttttgtaccttctaacgcgggaatcaataagtctttttcatattcggtagtatcataatgaaaaggagaggccgtgtgtagaacatacctaatctcacgtccacgtttctgcagaaccttatcgaaagcatttggatgagaaatgtccggaacaatttctaaagttaaattagggttatgttgaaattgtcttagcaattttgcttctttttcatgggatctcacagttccaataaccttataatcttgttttaacaattgtgacaggatatgcaaggcaataaaacctgaagcgccagaaactagaactgtattagacatggtgtgaaacgaacgaaagctttcaattaatctagaaggaggaaccaaagttgttgaacggattaaataagggagtacaggtatgcttatatagtggaaaagtgttcttcgaacctttcgatgaaataaaaagaatggaaacgggccttgtgacaaagctcgcaggggcctgtattatatcatatccctttacaaacaaattttccgaaaagaaaagaaacaatttcttctctctcagaaaattaacgtattatcgattctgtcgttttacacactttactgttaattttcttttctgcatcgcgttacctactctttaccataatagtcaaaatgtacgatcgcatgcatgttcgctgcggcacccaaaatagatagagtggattacaatttaggctatagaacataaacaaaaagtatatgcaaataaaagaggcttgaacaaatcaagaaagaaggagggcaagaaagtcttttgtgtgaatttttacagtccatttattgtaacttagaaatcaaattgtgcgactggccattgttgctgtatttaataatgtcgtataacactctaagattccgtaatgattcaaaagcagaaattcgttggctctagagtcttaaacaacttacgcaactacatatattcatgattcaaacagaatgtacctttaaaggttagaaatacgacctctaatctgctttaagcagatgatgcaagtgccttcatgtggttaatatatgtgctatcgtattaaaaaaagtttcccttctcacgtgtcaataaagcatcacgaaaacattcaatactagtgtttttcgcacagaaacttgccaaataggcacctttatgcagcacaataattaaaaatgcccaacgtgacacattccaaggtaattttgaaaaatcgtaagcgccattcgtgaaacagaatagtgttacacccgtgagagtaatagcgaagtcaacttaagcagatattgctactttaatccgcttatgctgaatccatattcatcttttatcagctttggacgagaaattagttgtcttttaggcaatgttcgtgagtaagttggagaaaagatctgtttcaaaagagtcaacttgaagtaatgtctcaaaaaaaaaaatgatagtattgcttgctcaagtgctaattatatcttttccttgacaaaagtacaagttatgcgtctccatcggaagtattttaagtagaaatattaggtaccaaaagaagtaaaaaattaaagctattcttattgggtcacactgacttaaaaattaaaggaaaatatttaattgcatgttattttgtttaactactatcttacttccactggtccaccggaccctcaggcttccttgccttgtggaaccagtttttttctatcgagaggaaattctccagtctagtgatattccatatgagaatggaacacaggtaagcaaggcagtggtgctgattaatgcgttgagagtgccaacagaaagaacagaagcttgtttgggcaggatatgtacaagaatgaggaatttttctttaacagggctaattttgtagttttcttttgagcgatacttaaatagcattttagattcagaaaaaatgcgttgcctagttattgagcattaaactgcgcccataaattcaggaggcactaccaacccctgccacagaatatttactaggtataagtgtttaacagttgcaagaaccaagcacatagatgaaattattcaacagaagattcaaaacgtaaaataaaaaatattagcgccatccactggcctctgtactcttttcttttctttctttttttttttttaacaagaaaaatggtacccgggtatcgaagatgtttcattacacaaaaccttggcacatgattcaattcaccctaacatcaattaactctattcgagaaacatgtgcagctaactgtagctacctcgtttatatatcgcattcattcttgattgtggtatctaatttcgaatgccttagtgatagtgaacggcatcgtaagcttccacgggtaggtacgactctcagtacatcattgctatttcacttcagcttgggaaaagaaactgtaacattatcccgcggcaatcgtttagagcatactaatataggctaagacaatagcttccgaacgagggtccttgaaaaagaaatatgacaggcacgtaaaagggttcttcgaaggcacatggcgcccctataacgtcgatcttacattgcacgcatacgaatacacattggcgccgcaaaacatatcttcatatacgaagtttgtgacgaattcacgaatcgttcaaggacaggtgcatttctatagttacggtggataaggtgtgttagatgaaatatgtaggatcttgaggtgagaaaagagtgtcagtcagtggctcgtttgggcagcaccagctggtgaaggaatttgtataaatagagcagacttgaccgcctgtctttgtgaatatgcagtcatttttttcttcctagtagggcttatatcagcactaaaaaacaaaacaaatacaatggtcaaattaacttcaatcgccgctggtgtcgctgccatcgctgctactgcttccgcaaccaccactctagctcaatctgacgaaagagtcaacttggttgaattgggtgtctacgtctctgatatcagagctcacttggcccaatactacatgttccaagccgcccacccaacggaaacctacccagttgaagttgctgaagccgttttcaactacggtgacttcaccaccatgttgactggtattgccccagaccaagtgaccagaatgatcaccggtgttccatggtactccagcagattaaagccagccatctccagtgctctatccaaggtcggtatctacactatcgcaaactagagacaaacgccaattttacgaacgggtttccatagacattgaaaatgaacgaacaaaataaaataaataaaaaactacttttttttgatgatataaataccgtagattatataaatgtatattaatattataaacctatttgatcaatgacagtgttcgtgaagcattttatgaatacgatgaacataagaaagaaacttttacactattgtagaaaaagcgtggacggtaataaagctaacagagtatttccaataaacaataatgaaattggaaacgtatgacttcgcagcactttgtctttccataaaaatgtgtcgctgcttcttttttcattttttggcgcgtcgcgtcgggccgtatagaatatgcgtcacttctaagaacaagactgcagatcagggcagtgcgagttacaagtcatggtaccaaactctcatttggagatcctcattttttgacacctaaaatattaagatttatggtttgggatagttttttgtaactgtaactagaaataaagctgaggggttagtgttctaccaaaactaagatagagggtggtaagatgaagtgagatgagacaatatcgtaatatccgtttaagtatacgccgctgataagttataatatagtagggttatttgaagtttcgttataactctacaaaaacaacgtacctatcaccgtatcgtcttgttcagatatagtctcttcgtatgagtagtgtcacatacaagattaaagatgcatcagttatccttttaggatattgcggttagcatatgggaatggaaataggatgccattgtatcatagcacccgcatgagtgtgaacacactaccgtattatagctcagtgaatagagagtgttacgacagtgaggtggcatagtattctaatgtaaggtctgtgtaagtaagaaatatcctgaaatggcatccgttcaagcaaattgcaatattaaggaacttttacgttagtgataccatgatagtgttgctaccacaagtcaatatgtttatgtattattgttgaaggatagaatatttttatgtttaggtgattttggtggtgatttttctgtaatattggcataagtgtatataaattgagtggttagtatacggtgtaaaagcggtataacgtatgtattaagagcagttttacaatatttggggccgccgaatgagatatagatattaaaatgtggataatcatgggcgttatgggtaaatggcacagggtatagaccgctgaggcaagtgccgtgtataatgatgtgagtgcatttgtactgatttagtgagagatgggccatggagtggagtggaatgtgagagtagggtaagtttgagatgatatatactgtagcatccgtgtgcgtatggcatatcagtatacaagtgaaggtgagtatggcatgtggtggtgggattagagtggtagagtaagtatgtgtgtattatttacgatcatttgttagcgtttcaatagtggtgggtagaacaatagtatggtgagtagtagatgggagatggtagggtaagtggtagtggagttggatatgggtaattggagggtaacggttatggtggacggtcggttggtggtagtacacagggagatggatggtggttggggtggtatagttgaatgagtcagggtaacgagtggggaggtagggtaatggagggtaatttgagagacaggttggtcaggcttggcttgtcttagtcttaggcttaggcttctctctggtgtgggtgtgtgggtgtgtgggtgtggtgtgggtgtgggtgtggtgtgggtgtggtgggtgtggtgtggtgtgtgtgggtgtggtgtggtgtgtatatatatgtcactgtattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttctattatattggtcttttcgagagcggaagaagttgtaggctaagcgcaggctaagcgtaggtccatatttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgggacagacagtcgcttatcttagtgagatttcttattaactgaattttctttgctgctgctggagatttgcacctgcatagcgcagattctgcttcttctcaatagagtagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccctacatgttcttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaagaccgattgggtgatattttgcatattatcttgcgagcatgtgcgctcaatttcggggcgggtccccgtggtggcgctggtgacgaagaggatcgatctattacgaatgaagaacccattattccctctgtggacgagcatggcttgaaagtatgtaagttgcgtagtcctaacactccacgaagactcagaaaaacactagatgccgtgaaagctttattggtgtcgtcttgtgcttgtactgcaagggatttagatatatttgatgacaccaacggcgttgcaatgtggaaatggatcaaaattctgtaccacgaagtagcgcaggaaaccacgctgaaggactcttatagaataactttggtaccttcttctgatggtatatcagtatgtggaaaactttttaatcgcgagtatgtccgcggcttttactttgcatgcaaggctcagttcgataacctttggggagagttgaacaactgcttttatatgcctacagtggttgatattgccagcctcattttgcgtaatcgagaagttttgttcagagagccaaagcgaggaattgacgagtatctggaaaacgattcttttcttcaaatgatacctgttaaatatcgtgaaattgtgctgcccaagttgagaagagatactaacaaaatgaccgcggctcttaaaaataaagtcactgttgcaattgacgagcttacggtgccacttatgtggatggtccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcattgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgattaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttgg

SEQ ID NO: 12208 - DNA, 574860 bp, Saccharomyces cerevisiae
cgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagtggtaccttcgtgttatctgcagcgagaacttcaacgtttgccaaatcaagccaatgtggtaacaaccacacctccgaaatctgctccaaaagatactccagtttctgccgaaatgttttattgtagaacagccctatcagcatcgagaggaatgccgtccaatgcggcactttagatggggtaactcccagcgcaatctgatctcgcaagtgcattcctaggcttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcctggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaatatttcaaatatcctacagggtccccatgatatggctcgatgtcttccaagtattctttgtattcctcgtcatttcgcagcattctctccacagctagtgcttcccaagccatcctcctatacgatactttctggccagcccaacagacacagagctcgaacatcttttgacagcccttgcataatccgtattgtgtgaatacgccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtagcattagtgctggagttggtgctagcagtggtagtagcactagtgttggagttggtactttcggtggtagtagcactagtgttggagttggtgctagcagtggtagtagcactagttttggagttggtactttcggtggtagtagcactagtgttggagttggtgctagcagtggtagtagcactagttttggagttggtactttcagtggtagtagcattagtgttggagttggtactttcagtgatagtagcattagtgctggagttgatacttttagtggtagtagcactagtcctgacgttgatgctggcagtggtagtcgcattagtgctggagttggtactttcagtggtagtagcactagtcctgacgttgatgctggcagtggtagtagcactagtcctgacgttggtgctggcagtggtagtagcattagtgctggagttggtagtcgcattggtactggcattggtagtcgcattagtactagcattggtagtcgcattagtcctgacgttggtactagcagtggtaatcgcattagtactggcgttagtactggcattagcactaccatgaatgcacgtgttgctgtcctcatcactgctgcaatactttctgtacctgtcactgctattgctctcctggaagttagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaattggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgttaccgtccgtgacaaactcctttgtgcgagacaccttttctgcagcatccagcttcccgtgtatccataccaccctaaaatactttctccaagagcaggccaattcttccacttcgttggttgtgcttgcaactacaatggccttcgactctggttcactttcaaagagggctaaaagaagcttcagtgcttcttcgggctgtgattccactttcttccgaattttatgaacatgccctaaaggcacctcggatttctccttgattagattaaacatccgtgttggatagctggatagacctctgctgagatcttccgaccgtttgagctcgttgatgtccatcgatttcttggccagtcccgtaagcccaatacgctgcaacgcagcatcagctacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgtaaccttcttcaataaagtttcttacaggggccacattcaagcaaccgcatcggcccaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcataacataagcgcaactgatgcaagtccctgaattcaaaggagctgccaaagagtttctggcctgcaacgaggatatcgtttgtactcttgggctctcggggcctttttcgcgttactcttgagattttttggtgatgatctgaactcgccgcctcacctgccactacgtcttccgcattccgagtactagagaatgaacaatggtagtcgctttcaaggcctaaccattgaatccagcgctcggaagctcgttcctgcaataaagtggcggtcgtcccactgacactagttaacgaaaaggaatccacaccgtaaatatttcgccctgtttgaacggaatgattggccatgagttcactcgtcgccgactcgtacaaatctgtttcaaatctgctacctacgcagtgccgtcctagggcaatcaacccctgacgcatctcccgaaaattcagcttctgaggtgcattcttcggaagttccctcatgtactgccgaaaagttgcgtattcaaccagacagcccttcgcggtattcagaaacatgtaggaatacaaaactatcctcgaaatgtctcgatttgttacttgatttggatcctcaaatcccaccacatccatccaaggatcatgattaaaagcgtcataactgttaccaagcgtcataactgttaccaagcgcacatatttgcatttgccttagcacagtgacaaaataaaacacgtaatctgaagtgagtccgtcaagcgtctttagtcgaggctccgatgaaccgttcttgttgtaatcagtgtacagttggatgcgtcttgttgtatcatcgacgtatacgttgcgctgaggaccggcaaaagcgagtagctgaagctctggataacggtaagggtatcctacggcaaaatggatcatccacataagtggcaccgtaagctcgtcaattgcaacagcgactttatttttaagagccgcggtcattttgttagtatctcttctcaacttgggcagcacaatttcacgatatttaacaggtatcatttgaagaaaagaatcgttttccagatactcgtcaattcctcgcttcggttctctgaacaaaacttctcgattacgcaaaatgaggctggcatatggaagcagttgttcaactctccccaaagttttccacatactgatataccatcagaagaaggtaccaaagttattctataagagtccttcagcgtggtttcctgcgctacttcgtggtacagaattttgatccatttccacattgcaacgccgttgttgtcatcaaatatatctaaatcccttgcggtacaagcacaagacgacaccaataaagctttcacggcatctagtgtttttctgagtcttcgtggagtgttaggactgcgcaacttacatactttcaggccatgctcgtccacagagggaataatgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttgcatagctcatctacgtgtaggctgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcacgtggtttgtttgaagggattggtccgccctggaaatctggttcgtcttcaacaaacgtcaggaacttttttacatttttcccgaccatgacggaaatgacaactttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcagcaaaagcaaacaaaatctcactaagataagcgactgtctgtccccttcaagcacaacatagaaaacagaaggatgtctcattcatcgcttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctgttggatactttaaacatggacctacgttccgctctcgaaaagaccaatataataaaaagttataaattacatttccttattaggtatacgacctcgcgcttcgaagtaaaggagccctttttggcgtacctacatatggcgcgtcagaaagacaaacttctcccaaaatgtattaccccgccgaataagaaagcagacccattcaccaacgacgtatcaagttacttcacccacacccacacccacacaccatgctcaccttcacttgtatacacttatgtcaatactacagaaaaatcaccatcaaaatcacctaaacataaaaatattctacctttcaacttcacgaaataaacactttgacttgaagtatgaatactaccatggcgtcattaacttaaaagttccttaatatcgtcatacctctatactctattcaatatattgtaatataaatgcactctatagtcatacaaatacttttacttcaccctatcttcgcataccattgtcatagaatctcacactgacgcatgattaaaacgaataattttactataaggcctcccatccgtgctctatccttttgtttgcaatatttatatacagaatctcaaaacaagcgggagaagtggtaattacccagaggtcatgcatgatcttagcaccaccgtacctctatgaagctgcacaaatgttatatatcataccaggaatacacataagtgcaaatgctattctacaatatcctcatcttaccagctcactcacaaaatattcttactccgagtacgaccataaagcaatgccgacgaatagtcatactaaggtactataaaatctttccgtgcgcttaagcggacaccatgccataatgttaaatgtaataatttaaaagcatcataagagtaattttccagtattgcttcagtaatgcaaggcctaaagaagaacgcattttggtatggtaaacctccaacctactagtaattaaaaagctttagtttaacctgcagttcgggacacacttcgggcataacgtacgtttattataaattttttatatctcttgcgtacccatgtatattccagaacagtcaatgcacttttgtgagccatttatgctactttcatattccccattaaaacaggtactactgttgaaaaggcataataacctgaagtttcgtatgggttagttacactaggtgaaggatcgtttgcctccatatggtcaagccattcgcggacattgataatagctgggacaattctggtttcataaagggtttcattcatccagattacggatacattcaaatagtagtcgccaaatcctgatgcctcatcaaaatgaaaatatgtctctaacggaactgtattagaccatgcgctcagcgtagctgcagtcgcgttggttaaaacgttagctaagtttaccatcgtgttagtagatgatctgttatttcgttaatagataactttacagaagcaccatctcgctaccatttatacgctttggaataaaaatcagcccttgtaaatttcacatgctcgaccgtttaggagattatgcattttaagtcgttcattaatattactgtagcgaggaagatgattattgatttcgaggggtataatcatatgcggcgtgaaaaataatgacttgggttggaagccgttaggatagtatttatactgtcacgaaatttacaggaagttgtaaatatgttgcataaaatttttgatagcaaagccaccgactcttcattatggagttttttttctcttattctcctgttgccttcgtactgtaaaccccagtcatgtaaaatgccatatggaggctagaagaatgaaaaatcaatttatattttataatacagtgtcaatattgatcgaaggatgcataatatatacactggattgaccattcgaattatatatctatctattctatacatccgtgtaacttagtaagaaccagacaccaaaattatttttttatagaagatccttcttgtctttcatgtacctctttcagataccactgagtaatatgactttaaaagctctactgatatcatttatgtattaacatgtctgaacaataagtatctttttaactgtataagaaagcatgagaattgtttcaaaaacctctcatttatatatggaaggaaattagagaaatattgttcgtagtgtattccttaaatttacggcaggaagagttaaaaagaaaataattcaagattctctacttaaattaatgcatcctttccattaatagtttataactggcgcgatgcaatacactggaaaaaattaataatagttataagtacgagaaatatctactcctaaaccaaataatgtgacataaagtatacagcaaatatctcttcaagtttaattttgatatggctaaaaaatgcttattcgggatggaagtgaagcaactagcctaccaaacgcaaccattttaaaaaagccaccagcatccattgcataacaagtcacagtctgctataaacgtttcagggcaatgctcacagtgagcacaagcactaacaatttttaaataatgtctaactcaccataggccacactataatggcctgatttccctcaatatatgtggctgttgaatttgcagatcatcaccctgtgcgttttacaagatattccttaatagaacaatctaaattattctatttgaaaaaaatgaacaataattaacacgagaatttaaaccatactcggccggattagcgatcatttcgttagtaattaaaattaacatttccatgtgggactctaactgctgcatcgccaagttgataagccatgaaatcaccaatatcaaagatagcaatccaactggaaaaattattctcggcatatgggtgatgataaaaagcgtagcttaacaaacaccagtgctggttattatctgtaaaatttgattagatttcaagggaaaatctgtttgaaattgcgtttccttgttggcctgccatactttaattgaataaaagctccgtatatgcttctgaaaaataagcaatagatccagctgactcatttcctgtatttctaaggggaaatgcgtagggaagaccaatttcatgacgatagattgaaacggcaatcaacatctgaagaaaagaaagtagtatgacagcttgatgtcttatctcatttactactttaatgacttcgtacaacttcactgagctaatttacgccatttttacgcagattatgatattcatttcttgagatatgaggtcgactggcaatgcctactcttataaagagaaagtttttgaaaacacagtacgtttacaaaacgatatcaatgaaggttgtagctacatgctcttcaccagactaatatatcctcttagtaaagcgctatataatagtaactcaatattttgtaaatacaataaggttaacggcgttattcattttcgtctgatattcatttgcaatttgcagttcaacttttcaatgatgatttagaatgatctaacactggaagttgaagtttttcaaaaatttgctgtaaaatttgaccgatttgtgagattcttcctggctgtcagaatatggggccgtagtatattgtcagacctgttcctttaagaggtgatggtgataggcgttgagtatgtgtagtgtttgacccgagggtatggttttcacaagtactgcgcactgtattgtgaaagcagcttcggggtgcgtgattaaaaaatgcgaccaagaataaacaggtacatcataacaagggccatttgaattgcatttatcaggatttgtaaccttgttctaaagaggcatcgtatagtttaagttcattttccacccaatttgatgacggtgtggaccttaacctattgtcttgaaatttaggttatctcttagatatcacatgtgattaccccagtgaacgcgtataagcttacagaaaggaaaaccggttggctcagtcaaaactgttgcagatttgggctcccctgaatatttgagacatccctaaaatgaagagatatatacagctaattttgaatgaaaatttaaaattcgcaatgaacagtactagagatgagcttttgaagtcctttcaaattatttgttcttccagttgatattttttattttatataccagtaccaaatataatcttgccatacatttacctttttgaggttgttcaacggaaatccagtgtatttacacattcttggaaacccatcgcttataatacgaactaatttatttatgaacaaaggctttggaaaagtatccctactttttacgacgctaaatcatgatacgaaactttaggaagattaacagtcactccataaaatcagaaagtattcgctaatagtggaaagaaatggttatataaagatggaaatatcttgaaagagacagtttaacccgaagttctgtcaaagtgtttgatttgaattgaatagtatcacagaatgcgttagctatgtacaaagaatctatcggcaagtatggggtagcaagctgcttaaagcttcttatcacactgtaacctctgttaaagcagctgcgttgttcttgcactctgcacgtaaatgacgacggccaatgtaaaaatagcagtcactgcaggcctcttggattgtacccgtaattacagcaattgccattagatttacgaagtcatttaattaaatggtttgatttatctccttaaatgcttccagaaatgggactagacttttttcactcaaacctgttcacaattattgctctttttcaattataaggtaaacaaggccatctatcagcaacacagtgctcgcattttttaattaaactatataaaaccaactatttgtggttgcgacttcactttttgttgaattactacccaatcattaatattgaagatgtgagatcatagatttattggctttgggcatctcaaatcccaagaggtcattttaaccaacaacattttaaaaagtagatttgtctgcctcagctatgagatgcgcatgtccctagcatctcatatctggttatattattttttccacttggtgaatgttgaaaaaaacaccactcgtccaatttatcagtttgcaggtctaatgtccttccctgttatttaaactgtatattgtaagcatgtcttatcgaaacaacttactcagttgtccgaaaacaaaactgcaaattctgtgtgtattcacgtactagaatcctgtcaaattggatcttgatttaagcttttatagcaacgaactttgcatactaagttttttttgttaaccggaactgccaagaagcattcagtaaaatacatcttcatcatttactgataatactcattcagactcatatcatactatttcgaattcattatacatcctcaaaaaccatattcttcagttgtaataaaagatagagcctgcatttgattcgatttccgtaatttggggggccaagtcctaggttgacttcatcttggatgtctatcgcgatgcatttagtgtggcatagaatttctctcttcacgagcagggaaggaattgtattatattatttggtaatcgcctagtcacagtcatttagaagaaacttagcatcattattccagcatcatgcaccagaacaggaaaatgccatttctaaaagtattctcatagccattaaacgattcaatacttttttggtagctaagtcaatgcctctctgaatattgtatactatatgaataaagtgatcccataatcagactacccagcacttagtagcgcattttagaactaaatatatattgcctttttaatactgtaacttgagaattcttaataaggaacaacaatggtccagaaggtgttcggtagaaagatagaaaattttaaaccatacactatcaagcaatattatacttgttctttaatcaagaggggattgtacttttatttgatttgaggccgggtatcttgatttcacttatgttatactgtctcttagttgataaattcaatgttacatttgctatctcattttcaggtcagcagctatattgaccttgcttacattcagcgcgtgtgaggcactacctttaaaactcttgtgctccttattcaccatagtctgttatccgtttgttcttacggaggaaactgcaattgatcatttatgaatcttttagtgaaatttagacactattaaaatttaataataggcaaagtacgtcaattatcattcttggttcctgaaaagttgaatctgttatgaagtctgatatttggggttagcattgtatacttcccttgagtaatgcattatccgtaacgccacttttaccatattcaagtgcaggtatatttagcattttttacatataatatactgacctccgaagctaggtgagagaaagcaaaggttttgagggctattttcaccattggaactaagatcgtacacactaattaactctctgccggaggcgcgcgatatatgggctggagcggtcctgactaaagtcctgctggaatattggtgaagtgtctcaaaaaactagtaaggtcaatatcagggaaggaactattattggccgaggcggcagctaggttaaagaatctagccgtcaatgcaacgaaggttatcaagtacattcagttggatacattaaaaaagttgaatacaatatcaattctagaagattgtagcaagtttggtgagatagtttacgcctataatatataagtgctaactcaatgttcagttagtagaatcacagcctgaatattctgtgcatcgtttactcagggacagatgcgatctcaatgcagggacgaaaaacagtcttatatgcgcacgccagcaaaatctttttttgcggcacctaagatctctcgcatgataaaagcataatatctttgccccacaaagtcaaggcgtattggaaaagctactttagttaataatgaaatgatcgcccatccgggtaaaaatggttacaattccagtgttgattattgttcgtttttcagagagaataatttagatgctcctattgaagaatatcttgttagcgcatagggcaatcatctacgactttaaccgcaactgcgtctgttaccgacattggaggattgtatgctcaaatgacccctgtggtgaagatgaacacttcttgcacactatggttgaatcttgacggtaccctcactcagagttttatagtatcacacgacgctactctcccgcttgtacattcattctggctagtttataataacgttaaggaaatgacacccatacctctcagaaatccaattggaaataatatttgtaaaagcacgtgatattgcctttttcttttatctggttaccaatatgggatcaataactttacttttgaagatcttgtttttccttcagataagaaatcaaaaaaagaatatatgcacaaaacagtatggatataatacaccttactcttggtcgtgattgaaaacgtaaggttctacataaattattgagaaagacttatttgaagatatcgagagtctatcatgccctttgcacaacaaaactaatgtcagcttgcccttgcaacatcgttatactcccagtcgagattttgaagaattcatctaaagatactaagtatagcttgtatacaacaattaatcgaggatatgatgtcccaagactcaaatatggcatcatagttagccctcgagtgcacagccttgagactttattcagtgatctgggctttgacaagaatatagagaaatcctcgctttacttattattaaatgatcctaccttagcataccctaatttccatgaacattttgaacagcttaaaggtgaaacaaacaaagatttatctctaccgacatattatattccgaaggtccagtttttgacagaggcattcgattcagaacataccctagcaaccatcggctacaaaccaaataataaggagagttatgagatcacaggttttacatccatgggtaatggttatggtataaaactattcaattacagtgtaattcatatgatgcggtctcataagtgtaaaagagtggttgcagatattatcatggagcatgacctattgggttactatgaaaagaagcttggctttgtagaggtgcaaaggttcaaagttctcaaagaacagcaccaagtaaaggtatttgacgataaagttgactttaccaaagactttcatgtgatcaaaatgattaaagagttgggaaatcatagattgtagtggtatagtcccgtacacactctatttgaataaactgtaggttctgctgagcaacatattgatataaacagtaaaaagaagtgggttccttgttttcctgcaattataactaaccgtgcttactaccaaaaaaaaagtgcgtataaatattcactatttacaatgttgaaggttccagatggatacagaataggaatcctaaatataaacactatatttatttatttttttcgaataaaagtcatgttagcaatatttatatagttgattttcctgcatttattatataattggcggcatagtaacatcaaaaaaaaaaaaaaaaacattcaaattgcactacttatagcagtagcatctataaaagttttatgatataaacctttacagttatctcaaatggttttgggattgtccatcaaatcaagcgtgattcatctatacgttattattctcctacaacccccttagtttggagagcgcttagagaaataaagcatcgatgttttcttaccttcactaaaatcaaaataaaaaagcttttctatagttcacgaattacgcaatttattctatcatccttaaagttgatcaattgcgattttaacacacattttcaaatgtcattttgcgcttgtataataggtgccatctggacactttataaaaaataaaggaaaagtaaaatataatgctgaaaatatagttgccttaaaatgccattgatatgatttttttttaaccttaaatctattggcctataatattcgcggcaaaatgagcatttgaaaatcagtaatagaatgctatcaaacttcgttcatgacctttttagcatcataagtgttgaatcgaatctatcagttcagtaattaaaaatactatttttctgtcagcacagaacgtaacgacttttccttatatccactattgatttctctttaaagtgctatgtaaagtacctaaaaaacttgttatagaagtctcattcgaaagcatgtgggctcaaaaattgtgaataagatacatagaaggagccgctgatcgacacataatagtagagttgaacctagttggttcaaccattatcatagttatacgaataaagccacaatataaatggccaaccgctgttgtcaaacaagactataggttcattttaacctggcgtgcagtacgctggtcttgctaacgcctctacaatacgtacagtgcaggttttgacgaatgaaagtggttagaagattaatgtgatagaaacaagaattttctcgcaaagatctgtatgaaaggaaacgtttggtaagaactctgcgatccaaattctactgaatgaatagaaggcttctacagaacaagttgtatcgaaatgattgttggcgactactatatttctataggcatgaaagttactcataaacaggaaagacgcattttagtagcttgacctggtcagattaatcagcttccaacgttacttccctttcgcaagaatctacccaaaatgtctcgagcatcttgataattacagtatcgttcgtcccgacttggcatttgtttaaatttctaagatgcttcctataggaacataattgtcaagaaagcacaacaaattgtctgcaatgtcaacaggagtggcgcattttatgttttttcatttttttttttttgtgcgtgatcattaagcgggatattgtccacagtcatctaaaagaatgaccatttcgacgacttagttcggaaaatatttccagcggatgacaccacttgccacagttggtgaccgccaaatctaagtcacgcgcggaaactgaaaggttgtgagtatataagtgatcactcgcttatataactgacgaggcagaacagggtgccaaaatgctcctcaatattttattcatttgagattcaaggcttaaagacagcatatataagaattatgacggccgcacatcctgttgctcagttaactgccgaggcataccctaaagtcaagagaaacccaaatttcaaagttctcgactcggaagatttggcgtactttcgttcgattttgtcaaatgatgaaatcttaaactctcaagctccagaagagcttgcttcgtttaaccaggactggatgaaaaaatatagaggccagtccaatttaattctcttgccaaactccactgataaagtgtccaagattatgaaatactgtaacgataaaaagttggcagtagtaccacaaggtggtaacaccgacttggtcggagcctctgttccggtatttgatgagattgttctttctctaagaaatatgaacaaagtcagagattttgatccagttagcgggactttcaagtgtgacgcgggtgtcgttatgcgtgatgcgcatcaatttttacacgaccatgaccatatcttcccattggatctgccttctagaaacaactgtcaagtgggcggtgtagtttcaacaaatgcaggtggtttgaactttttaagatatgggtctctacacggtaatgttttgggtttggaagtggtgctacccaacggtgagattatcagcaatatcaatgccctaaggaaggacaatactggttatgacttgaaacaattattcatcggtgcagagggtactatcggtgtcgttactggtgtatccatagttgcagcagcaaagccaaaagccttgaatgccgtattttttggtattgagaatttcgataccgttcagaaattatttgtcaaggctaaaagtgaattatctgagattttatctgcttttgaattcatggaccgtggctccattgaatgtacgatagaatacttgaaggacttgcctttccctctggagaaccaacacaacttttatgttcttattgaaacgtcagggtccaataagagacacgacgatgagaagctgactgctttcctcaaagataccacagattctaaattaatttcggagggtatgatggctaaggacaaagccgattttgatagactttggacctggagaaaatctgttccaacagcttgtaattcttacggtggtatgtacaagtatgacatgtcacttcaattgaaagatttatattccgtatctgcggctgtgacggagagattaaacgcagccggtttgattggtgatgcaccaaaaccagttgttaaatcatgtggttatggtcatgtcggtgacggaaacatccatttaaatatcgcggtaagagaatttacaaaacagattgaggacttactagaaccatttgtttatgaatatattgcatcaaagaaaggttccatcagtgctgagcatgggatcggtttccataagaaaggtaagttacactacaccagaagtgatattgaaattagatttatgaaggatatcaaaaatcactacgatccaaatggaatcttaaacccatacaagtacatttgaactttgttaatttttaactttcaaagagcaaaccctttttctttacagtattatagatttacatatatgtatttatcaatttattattgatcaaaattaatataccataaaatatttatcttaagccgttgttcttgaacgattttcggtgaagaaacctaagagaccattttttgtggaaaaaggtctcgttttctatagatctgcgaccaggaatctcctgattgcgtactacaaaaagtgttcgtccattttttctttactacattagataattatacataatccaattggagtagtgacatgagtattggtataaccttaatccaacaattttaaacacgtactaaagtgatctggactcattaaaactcaaatctcgtccagttttttcttcatttgtgatcaacatccagggagacacggagattatagtagtagttaataacacttcgcaattacttattcaagtatgttattaaatagtgaagaggaatgagttttcagatcacatgttattctccaagaataattacataagttgccatttcaaatgtgcgcaaactaccttctgtattctttgcgctaatgccttactcagtctcccacttttaacgtttatttcttgtaagagtcgaaactaaaccttagttgagcttaaattcaatcaagttcaagaagcgttctggcccacactttaaagcgactacaattaggaagagctcactaggaccaacgtattcaatgtggatatcatgaaaaatttcatctccaaaaagccaaaattctactcataatgacagtggtgagaattagcaaggtaaaatattggcattatgtggcaggagaagggaaatacgagagcggagataagttggatattaatgagctttagatgttgaaaaaaaaagaaagcgttacaatgctcaataaaacaatgacttcccggaaaagattttttgattattttattccgagaaaggccgatgtatgctgaaccaacgtgttgcttgccaacttcagcatactttgtttgccaccctactaggaagtgaccccgagaactttattttctgcacccatgggtgcctaaaacttatttttctgcagggcgtttgagaaataagggatatggcaaaaatcgaaacgtggggtagtttcgtgccttcttatgtgcctatcttgatttttgcctttgtgccttactctccttaccccgcgataccccaccgtatatttactctctccttggcacggacctaaaaataactgtagaatgagctcaacaaacaggtaactttacgtaaactgttctttttatctttcagctcgccattttctgatgcagtacatagaactgtgatacgtcattatatagacttttcgcacacacaaccaattaagcttgcgcatcagtggtggatatatggacggatacctcgtatattctgttgttgtcgtgggagagggcatcgcaaagtctagaagtaattaaattactttcagcgtttccaaatgagttcgagaacaattatattctagggggaaggaggttacagcggttgcagactcatagttccaaattccatttattttttacatataaatagccaacatttatcatccaattgttaagattttcactttgtctagatctttccctagatcttcaataaaaataaataaaaataatcaaagaaaaggaaaaagaaaaagtaacaatttaaacaaaaaaaaaaaaatatgacaaaatcagacgaaacaacagctaccagcttgaatgctaaaactctaaagagttttgaatcaactcttccaataccaacttacccaagagaaggtgttaaacaaggtattgttcatctgggagtcggtgcattccaccgttcccatttagctgttttcatgcaccgtctgatgcaggagcaccacttaaaggactggtccatatgtggtgttggtttaatgaaggcagatgcacttatgcgcgatgccatgaaggcccaagattgcctatacacccttgtggagcgtggtatcaaggacactaacgcttatatcgtcggttccattactgcttacatgtacgctcccgatgatccaagagctgttattgaaaagatggccaatccagacacacacattgtttctttgacggtcacagaaaacggttactaccacagtgaagcaacaaactccttaatgacagatgctcccgagattatcaatgatttgaaccacccagaaaagccagatactctgtatgggtacctatatgaagccctgttgttgcgttacaagagaggtcttaccccattcactattatgtcatgtgacaacatgccccaaaatggtgtcacagtaaagaccatgcttgttgcatttgccaagttaaagaaggatgagaaattcgccgcctggattgaagacaaggttacttctcctaacagcatggtggaccgtgtgaccccacgttgtaccgataaagagcgtaaatacgttgctgacacctggggaatcaaagatcaatgtcccgttgtcgcagaacctttcatccaatgggttcttgaagacaacttctccgatggccgtcctccatgggaacttgttggtgttcaggtcgtcaaggatgtcgattcctacgaattgatgaagttgcgtctacttaacggtggacattctgctatgggatatttgggatacttggcaggctacacctatatacatgaggttgtcaacgacccaactatcaacaagtatatccgtgttttgatgcgtgaggaagttatcccattattgcctaaagtgccaggtgttgatttcgaagagtacactgcatcagtgttggaaagattctccaatccagcaattcaggacactgtcgcacgtatttgtttgatgggctctggtaagatgcctaagtatgttttgccatcaatttacgagcagttgcgtaaaccagatggtaagtacaagttgttggcagtatgtgttgctggctggttccgttacctgactggtgtagacatgaatgggaagccattcgaaatcgaggatcctatggcaccaaccttgaaggcagccgcagttaagggcggtaaagatcctcacgaactgcttaacattgaggtgcttttcagtcctgagattcgtgacaacaaagaattcgttgcacaattgacccactccctagaaacagtttacgataaagggccaattgccgctattaaggaaattttagaccaagtgtgattttaaaggtgaactgatctacgcgccctcgatagtaatgactaaatatcttgggtagagtatatataatgtcgtatttttgtatattgttttatttagacaaatagtaacgtgttatgttccttcaatcgcatctttcatgatctttaatcgatcgtcaaatggatccatttagagtttctcatcaccatccccatatcatttcactccaccccgctttacgtaaaaaaaaaaaaaaaaattgaataaatgactaagaattagacacaattttgtcttaatgaatgctttttacttatgacacatgccagtttgtacatatgttgatcttcatagctccgataatcttcataaattcgtgacaaattaaaattacacattattatgtaaactataatatacaatgttgcctatcaagacaaacatatgcactctatgatcaatcagaattctttgagaacttcaaaaatttcttccaatccttcttctcggtcttactttcttcggaagaaatacctctcctagaaggtgggacccaagatgcagatttccatggttttataccttcttcgtatagtaattggatttcctccaaagatagaccaatcgtttctggtaaaaagaagaaaacgtacaaaaacatagcaaccaaacaacctacgaacacataaccataatagaagtggatagacccagtaatgaatggtgtgaaaaaaccgatcaaaaattgccataaccagttgcatgcagttgaaatcgacatggctctagacttgaccttcgaagggaacgactcggcaaccacaatataagcaacaggagcccatgtcgttgcaaagcagaatatatagaaacaagtgaacacaatcatggcattacctgcacctttcgaagaaggaccgtcctggccatgagggtaaagacatttcaccccgatacttgcaaatatgaccatacaagccatcatcccagctgcaccaaataacagacatttacgacggccaattttgtctacgaccataacagcaataatagtggagaagaagttcactgtacctaggacgatcgacgtctcaaacccatcagtaagaccgactgatttaaaaatggtagttccgtagaagaagaagtagttttcaccagtaagttgcaaaaaggtttgcacaagaatacctgtgatcaaacgttgaaggactttagtttttacagagaaaagttctttccatgaagcttctcctagttccctttgggcaaggacaccggcgttgatttcatcagcctgtttgagtacccatggatcctctggtgaaaccttgttgattttggcaatggaagcacgggcctcttcgtgtctctcacattcaatcagatatcttggggactctggaaccaataacataccaatgatgataatcaaagcccataaaaagcaaagcccaagggggactctccattgtgcagtgttatcgtattttctcgtaccataaacgctacaataacccaagaaaataccgaacgtcatgttcagttggtacaatgagaccagtccacctctcaaatctgtgggggctatttcagacaaaagcattggacacaacaccgaacagccaccagcaccaagaccgtagatgatcttaccgacaaagtactggtaccatttgtgatttgaactgatctgaataattgcaccaaccatatataccaacaccacgatcacaattgccagccttctacctaaagtatcagcaagacgggcaaaaataaggccacctatggcacatccaatactgaacatagccacaagaagacccatacgcacgttgctcaaataatattcaccagtgctatgcttgtaagaaccgaagttcattttaaagttgtccatgttaatgaaacctgctgtgataccactatcccaaccaggcaggaaacccccaaaggatattggataacacagtaagtaaatgacaagataacctatgagccctctttttggtggctcaacgttatccccgtttatgacttcgttgtcatcaaatccatctgaccactctttttccacgggtggtgcgacatgaatatcagcatctcgaacatctccatcgctatcaatagaggattgcgcactagacattttttttttttggtttaacttttgtttcttttttctttttttgattgttatgccttacgtgcaaagtaggaatagaaattttacctcaaacaactctgtttcatctgcctcttttatatgactttttagttgcaattacttgctggaagatacgacctcacacccttgaacgataaatttcgacaaacactatgttcatttgcgcatatatccaggggaatcaaccctagagagtactgtcttttcattgggttctgaatatccgtaaaccaggagttaaaggatattattatctaatattatcctcgaatatctacgtcatgccgggctagggcggattcaacctcaccatcttgcctacctacaacccaccgcacaagaaagcatcccacgccgcgtggtgcctttgttccttggttcctgaactgatgattatactttccccacgcacatgaaacgcataccccacccccacatttctcatttaatattttttagttttaactccggtgcgcgccccttgaagttaaattaaactaactgtctgcatagttcaataaacgatgtcgacaacgattaggtgattggctagccatcgcaacaagcagacatcaactgaaactctaaaatgtagtcctacagacaaaaaaaaattgttgttttcaggcttatgttcaaggaaaggaacacgacaaatgattgtcaatagtatgtttctctgaaggcacaggttactttttattgaatgtatttcaaactgcctttagtaaggaaggtgcttttgcaacactttgccccttcgttgtgaagcatttggcagtacagcgataaatcctagacattattaaattggtaaaagggtgccatagaaggacacgacaaccagagctcgtaccattactattttgttccattctaaaattatagaattcgcgttaaaatgtccgggtttctcagcacttcagattatagacattttgtgaaatagcaaattgcagcacgatcggtgattagcaataacggtgtccgagtcctttccctctcatgtttttttttcaactacagtaattctcagcagctgcagccttgaaaactataggtcaatgataatatgtattaataaccaactcttggcgcttacaaaattgatttatttagtcaattgacccacatggaagggtaaaaccgcatacaaaaatttctcttacaaaggatcttatgaacatatcaaatcaattatagaagccggaaagactgtcatcctatatagggtggcaatgttattatcaggaagggtaaatctcatttctaaattgcggaaggagctttgctctggttgaaattattatcattatcgctacttcagcgatttcaattttgcttactagataccagcgtcaaggtcctatcttttgttgtgttgctgcctcaaacatgtcagtttaagtttgaaggttgacactgtaaaatttactttgtatattgcatttatggatgatttacagtgtttcaattatgctctattgaggatagtgcttttgcagaatatttcacttgaggccacgcatactggcctaaggcattacattttgaaataatcttcgcatggggcttgtcacagtcatgaaaggggaaatagcttctagtatctggcatgatatgtccttacagaacttgatctttcacagcataagaattattacatcctaatatagatttccgacactgcagtgaggcagatgccaatattgaatcgaagttttgattaaggtatgtgagagtgtgattgtttgacatccctccagttgttcgaagatatcaacggcgcaggaaagccgctgataaaatggtcgctccgtggttgaaattgtagtaaataaccactttttcttacgtagaactttatccttttggctgtggtttgaaattattcgttttcttcccaaacgttgcagggaaataagaaaaaagaaggagaaataatacctgacaacgtagcagcgagccttagttcatctgctcaggttgaaaaacattgatcttgagcattttcatcttgcgctttaaatctcttggagtataattaagagcaaattgtaacagtattatgacatttgcaggactcacacccagaagtcctttccaccacttcagtactgtaacttgaaaaaaaaagggagagaattgatctaattaaaattatatagttattcaaattggaagtaaataaataaggactgccggcccatttttcttttttttctcttaactgacctgatatttttgaaacacttaacgccgttttcttcaattaaatcagaagtgcaattagtggtgctatgttaacatatgtttgagagcctactaaatgttagagtggacagttcttgcttacaatgattaagaattgatggctagtaatgtgggcggtcgcatctcgcttgtctaaggatggagttcctaaattcttcacgatcgggaacaggtcctttgtcccaacttgccagtttatcgtcaacgagtttatcaatctcgtcgtagtggatagtaatccatggatgatcttcattaccgcaagtagtccaattcactggtggtagttttacgctccaaaatctcttatcataatccgctatgcggtaaaatgtcgatgtattatgcgtaaaattgttataattgtctgttgtatccgtacagcataccaatgccaagccttgaaaggcgacggctagtgccaaaattttcatcctttcagtatacctgattttggctttatcctttcaatgtgcctgattttggctttctcgtatctttcgcctgataatatgaaaaagtatatactgtgaaaaaacaaccgttggagagctacgaccgactgaaaagataaaaatgcttgagtttttcaggttagcatgccgtctagtagaattaaaccattgtagttcttcacttttgtattaaacgtaggattgaggcggtggctgcttttggtttactatgcgttgtaaggggatggggaaatggaacgtccagaagaaagttatagttcccgtttgcataacagcagagacaaaaatggtcgagcacttccgtgttgactgtatatctgtgcatggttgactaattgttgtttgatggcctgaagttcttgtcacactctgcaaattatcccgacattcagacgtacacgtacaaaacacgaatgctactctagcatatccaatcgatcgcactgaagcgatcagctgatgatcaggcggtacattgcatactctgcgtaaggcctttttcaccaattgaccgcatcgtatatttcccaatccggttattaaatcgttatcaggcggaaaccttcgcgaacagtatactggagagtgttgcgacaagatatttaaaagcggaaaacgggcatataaaatagatgagtgcagactaatgaaaaagaccccagacccatctccaccttttgcaagcacgaagaacgtaggcatgtcaaacgaagaaccggaaaaaatggttaacgatcgaattgtggtgaaggccatcgagccaaaagatgaggaagcctggaacaaactgtggaaggagtatcagggtttccaaaaaacggttatgcctccggaagtagccaccactaccttcgcaaggtttatagaccctacggtcaaactatggggtgctctagcctttgacaccgagaccggcgatgcaattggctttgcacactacctgaaccatttgacgtcgtggcatgtcgaagaagttgtctacatgaatgacttatatgtcactgaacgcgcaagagtcaaaggcgtaggtagaaagctcatagaatttgtatacagccgtgccgatgagctcggtacgcctgcagtgtactgggttacagaccattacaatcaccgcgcacagttgctgtacaccaaagtggcttacaagacagataaggttctttacaagagaaacggatactgaaaccgctgtgtaatgtagactactgtgtatagagataactctagcttctataggctcacttgcgaagcttttttcccactttttcccagtgaaatagtttcttattggcttttcatagtttgttctccgatttaatcgcaagcgccgtacggcgcaggcacagaatgacttgcagcttaatccaggtgcattttaagaaacttatctgctgggaagaccccgaagttcatcgtttacaatgtgccgtaaagaacacatttgagggtgcaatctggttcgtcttttgccataattagtagtgctcatccgtgatcctttaatttacttttgtgatgcgatgatttgcagatactatataagcaatggacaccgtccatcaccgatgaggctagaacatcgtagtgctttgtaaaagaactgttaaagacccagtacgaaaatttttccataatggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaatattatctcacccaaataatttcatacatgcacatatagctactacatagtcaagaacatatcataacatttggtataacagtctttatatcagtctttgcatggctttgcatctgatgctggctctaccgacttctcggcgataaaataccaaaagaatttgacgtatatactatccaaagtggataaatatttgagttccaatgaggtaactaaactagttttttaaaacccagcagaaagaaaaaataccctatatttggcagtgctgtccatcagaaccattaactgcatcaataatagtttgggtgctgctgattatcataatcatgaaaccaaagcatatacaaagatagaaaggaagcctttccttccaactcttcttcttactagttaacaacaaatttgtgtatggcggcaaaatgtaagccatagtcgatgccgtagtggccccaatcagttcaaataatgctcctaaattacatgtagttaatgatatacccatggtgatgaagactagtgaagaagttataacgacgtgctgtttacctgataattgagtgtgttcgtcataatttttaataaggttgcattcatgtaacaagttaccgacaacatctctcaaaacaaaaatttccatggggaatgtggttagcatgttaaatccgaaacagagtctggctatgttgatagcagtgtctgttcctgggaaactgtttaaaacattgccttttgttttttctttgaaaactgcaaatcccgaatatcccattagtgcacagcatattactgagataatgatactgatatgcgttaacctggtaaattttgccacacttctattcctcatggaaaagaaaataaaactagtattatgatgacaaaccaacgcaaaggaaatgacagagagacttctgaatatagtagctttcatgaaaaaatcagataacttcagagaatgacctttccaatcatagggcagcataggtcctctaattaccactgtcagtacaattataatcatacttataacggccaagaaagatgcctttgatagtgcctctatgtttctcttcattgataacggaaaggaaatgaaagtagtgaccattacaattatgacatttcgcctgagccaaaaatgtacattaccatcgttctggctgaatatagctctgagtacgtggggtatcgtatccccaataattatgcaataaccaatacatccaccaaatgcaaataacccgtttgtaaatagaatcagcaatttcccttttttacccattacatgttcgaccgtaccctggtatgttctcttgccagcaagagtcaagttaatgacaataagtcttaacgtccaatcaactataaatccgagggctacgtatgataatagcccgcctaatataccagcatttttgatcgcgaacggctgagtaattattccggcaccaagaatagagtttgctagattcataaaagccattctcatactagactttttatcgttttctcgaagtacatcattaaccagagtatcatccatgtcaggagtaatgatattcaaagagttctgcccttggcttccgtcatcggagtcgttatcagttgtgcctggaaaaggaaaatttgtcaattcaaactccgttctaagctctttgttttctaatttagaatactcacctaactcagacattatcggaacatgtatatctgttagattctggtcgagatattctttaatggtttagtgtatgttgcgcttactactttttggcgtttttgcctatttcactatttacatatcgtgaaaatgacatttggttctaggttcgggtgacgtgaagataacgaaaaatgagtaaaaattatcttctaattatacattagtattagcgtgaaaatgtacacatatacatatatatatatatatatatatacttgaaggtctgaaggagtttcaaatgcttctactccgtctgctttcttttcgggagcaagattgttgtggtgaatcatcgataaaaataaatatactgagattatagtaagctcattgatcccttaaactttcttttcggtgtatgacttatgagggtgagaatgcgaaatggcgtggaaatgtgatcaaaggtaataaaacgtcatatctatgctacaacattccaaaatttgtcccaaaaagtctttggttcatgatcttcccatacaattgcctcaatgtctcttctatcggaatcgatgtcgacatctccaatcttccaaataaatctgcatctgaatatgcattgaaataagatccaaacagctaagaacaggaaaatagagatataggcggcagcaaagctaacaccattgaattttggtgcaaaagccgtgaaaccttgaataatgataatgatcgtcataaatgtggccgcataataagccaagccgggcattaatttagctttaaatggtaactcgtcacgagagatgccacggtatttcaaagcttgcataaatctgatgtgcgagattgagataaataaccatgcaaaaaagcctgcaacaccagtgatatttaatagccattcgaaaactttgtcaccaccagtagatgtctccatgtaagccaaagcgccaaatgcagcagtaacgaaaactgcaatgtatggaacaccacctttggtggtccttgacaggaatttaggagccaacttgttctttgatagaccaaataaaatacgggaaccaacgtaaatatttgaatttgcggcagaaataatggttgttaagataacagcgttgaagatatgtggcaaaacctttgtaccagagttctcaatagcaataataaagggagaagtagaaacgtaggaagtagattgtgttagtttagggtcattgtatggaactaaaagtccaatgaataatagagagccaatgtagaaggttaagatacggaaaacaacttttttgatggctcttggaacggattttctggggtttgcagcttcaccagcagtgataccaactagttcagtaccttgaaatgtgaaggcagcgttaatcaaagaggaaacccaacctaagaacctcccttcgtttttatccttagatattatacctggaccccaggcacctgggtttctccaataacggaatccaactgggccggtaaccccagcaccacaaaccatacaaaaacagtatattagaaacccgataatggctaaaactttgatggaagcgacccagaactcgaattcaccgtaatatttgacagggaacaagttcattattgtgataattacccaaaaaatactaatccatgccgccagtggaactttgtacgtccaaaattgaatgacttggccaactacactaagttccagggcaaaagtgattgcccaagaaaaccaatacatgtaaccattggccgcaccaaatgctggagaaaggaatctttgtgagaaaactgtgaaagaggatgtaacagggatgaatgtagccatttcacccaaggactgcgtgacagaatatgccaaagaacccataaataaatatgatataagagcgcccactgggccggcgttggtcagaggtgtggataaaccaatgaaaagacctgtaccaatagtaccaccaagggcaatcataccaatatgtctttgcttaagctctctcttcacttcagcgttctgtacttctccttcatcttcatcacctatgccatcctccatagagaacgtatcctcgccatttactctcgtcgggaaagagcgcaatggatacaattctttacttttctcatctttcaatggtattgacccacgtctgtggtgtgtttgtgaagcttcaacgtcgtgaaagagggttgtgaccggctcattgtacatatgcttctcctctatgtcggcgtcttcttttgaatttgtcattgctatgcctttttttttttttgtttttacaggagttaagaagtctgaagaactctgaaataaactttcgattgacgacagattaaaaactggatccaactataagtataatagtaacttatatatttctgttccagatatatacgtaaaaaaaagaaaaggataattgatgtttttgcaaaaagggattccctgattcggtttactctgttcgcaaccactcttctttctgctaatttgtgctttatctcgtatcattctcttatctacttatcttaaccttatcgtcttcctcgaaattttcattgatagagacaactgcaaaaaaagaaattcaaaaaagccgtatgactcacccggaaaccacacagaaaccctagatttctatagggcaaatttcagggttatactaaaagatatattattgaccttggttattcttcaagttcgccctattgaaaattcggacactttagggtttggaatctgttaaagatataagtaaatatgatgataaagaaataggtttaatttatacgcacttgccagtaagtgattgatattgcagaagtaacatgaatacggttctgtggcctttgctgtttgccgttattttatttcttttttttgttttttttctttttttcagcactatcaaggctaataagggacaagagttcttactcagtgtgaacgtgttctaaataagttcttgttctaattaattgtaactatttttatgcatttcttgtaagaggaactggagtaatcgtatctcggaaatacatagaggtgcgtattcataatgggccctctatcacttgttgcctgtatctccgaataggactgataagtgataaaaaaaaagaaaactgggttagcttgaagcgactttctttctctactaaagggaatggtcagatcatcaggccaacggcaaatgctaagctatttccaagggtttgtgcccatacacacaatattttactccgtgttccatcctacagaaggttctaagattaaatacgagtttccgccaaataatttgaaaaatcatggtattaatttcaacacatttaaaaactacatcataccgaagcctatattatgccacaagttgatcacttttaagtatggtacatataggattgtatgttatcctgtgacaatcaattctccaatatatgctaggaatttttttagttttaattttgtatttgtattcccatatgattgtgagacgtctccctacgaaccagctattactaggctgggcaaaatgttcaaagttcttgaagaacaaaatcaattgctatccaaatcggaaagagatccagttttcttcgatttgaaggtgttggaaaactccacaacaacaccctccactgcaggtccttcatccacgccaaatcctagtagtaacaccacaccaactcatcctacatccgaaaaggatacaaaggatatgagaagcagcagatacagtgaccttatcaaggatttgggccttccgcaatccgcattttccatacaagatttattgatgagaattttccaagacctgaataactattccgaatgcctcataccaattgatgagggaaatgcagtagacataaagatttttccgctgttgagaccaccgacaacttgtgtctcattagaagatgtgcccctgtcgtctgtaaatttgaagaagattattgatgtcaactgggatccaaccatgatgagtatagtcccttacattgatggcttaaacagcattgccaaaatttctaaactaagcaacagtgatcctggcctagtgatagagtgcatacgtcacttaatatactataagtgtgttacattatcagatattttccaattttctaacatatacgctccttcttcattaattaggaattttttgactgatccactaatggctagtgactgtcaatcttatgttacgttcccagaagtgtctaaaatatcgaacttgcccttaaacaaaagtctgggttcaggtgaccaagactcaccatcattttctgtacgaagaaaatccaaatcatctagcataccgtcaaacccggattctagaactacatcttttagttctaccagtagagtttctcaaaactcctccttaaattcctctttttcatcaatttataaagactggaggcaatcacaaacctcctgctcgagttcaaatattcatgtcatcaacaatcgtaaccgattcctaccaacaagatcatgcctatttgacctttataggtcactttcacaaggtcaaacgctgaaaacatggtatgagtcgaaatatatgattttaaaagaaaataacattgatataagaaggttcataacgtttggcctggaaaaacgtatcatttacaggtgctactcttttcctgtaatgataaatgcaggttcacgtgaaccaaaagaaatgacaccaataataacaaaagatttagtgaataatgataagttacttgaaaaaagaaatcacaatcatttgctttcagccacagggtctagaaatacggcacaatccggcaacttgaaaccagaaagaccatcaaaggtttcatttgaaatgcaaagggtaagttcgttggcaacaggcaaaagtactatgccgaaactcagcgacgaagaagaaggtattcttgaagagtctattaggaatgccgaaacatttgataaaatttgcgttttactgagcaagcctaaattagaagtcgaaagctacctaaacgaattaggagaatttaaggtaattaatagctgagttaaaattagagaaattcattgtccatcaaaatgtttttttttttttttaatattacaacttatttccgtaaataaagatagtacacacgaatccaaacgtttatatagttagctctgtgaaaatttgatttaggttcatctcttggtgtgtttggtagaggtggtttcacacccttctcttctgtcttgccttctaatgaataactgagtattctttacatactttgtttttattaaccactagtttgaatatatattcgactgaaaggcaatatcaactattcaatctttaacatttttctcgagccctcattgtccacattttcactggatttgttttcatcttcaattgcatgctttttgggcgatattacactttgcactgaattgctatttatgtttgataaccttaacggcattttcttacttagatttggtatttccttcaatatgttctcgatcatttcgtctttggtagcgttttccttgttaccatagtttttcattatgttttcaatcgtattatagatatcatccacattagttatatgagagtgtgttgatgttatcgaatttttaatgttatctttcaacatgttatgcttgttaataagctgctcaaattgatcattaaatttggtattgttcttcaaaagggatatagcgttctccgattcttccacttgtcctttcatgactgaaatagactcattcatcgaatttgatgatgtatcaacagtactcttgatttgcgatagcgtcgctgccatgctattatagaattcgttattcatggagtcacaatcatttatcagatcaaatgaattttcccatttaacgcgcttgggttcaaacagatccatttcttgatcaataaccgcgctggttgcagttgtcagattctgcattattagttttttattttcgtcaaggtggtcatttaggacctttttaaagttctcaacaaactcgtttgttctcttctcaatattttcataagtagaatccacatgacgattcagtaattcttgatggttattcttgaaaaaatggttttttaagtactgtttcatgttgttattttcttcgctaatatcagaaagattctcggctatatttttataaaatttttggaaatctactcttattatgtcgattttctcaataacaacattgaagaatttaggagattcgtttaaaattttcttcacacagtctttgtacattagttcagctttttcttgcatggttctcataagagtcagtacttcatttttgatcatatcaagatttggttggatattagtctcttgaagaatactttcctgttgcatagtgtttaattgtaaaaacagtgtagatttcaattttttaatttctttagtaatatgcatttcaaacttttgattaaggtcaagttctctttttttgtaatcatgtagggccatttgcattacctcagtcaacttctgtagtttgttattaaaatcggatatttcaatttcagttttatgctgtttatctagttgtgcccttaaatgatctatggtagttttcaatgattctatttggcaattttgagattgaatagtttcttttgacttcaatttatcttttactagcaatgcatttttcgatgtcaaactttcaatttctcttttacattcttgaacttcatttttataactttctaaatcactgttcaaatttttgtagtgatcttggctcatatatattccttctttggactttgtagagagtaaatcggatttaatctttgctaattccatagttatatttttaaccaaaatatccttcattataaatgaacccagttgcggcttgttcttaatgtttttagccttcgaagcatactctaatgtactgcaggtttcttcagaagttacctttgcaggcgatatagtagcaattagtgcggttttcgtattaccacccagggaatcttgaagcaggcgggtcaatttcgattcacggaaaggtatatggccgcttttatctacgagtgcgtttatgaccctgcccagcgtcaatagactttggttgattgaaccagcttctttggcacgttgatttaatgctccggatctgttgatgttttctgaaccagctaaatccacaagattcattttggaaattctaaatagttcatcctgatgcttcttatacaaagtgattgtaaaaatggtatgagatctactggaaaaatcgttcattttagtggacgctacttgcctatgctttaagcctttttgtaataggtttagcccctccatagcatttgttatgtgaaattcttgcaaattctggatgtatataccattagtttggtcatttggagccatcgaacttctttgaccgttatttgtgttggtgttactagaagcattattagtggtagagccagagttagaggaagagttgttcctggaattcactgcctgttgttgttgatactgttgcttgatggtattcggcagtgattttgtccttaacctttttcttaatagagcagctttaggtgttagatcatttaatgacctcggagaactgttcctagaattactcctggaactactagcactgttgctagtggtattatttgctgtgcttgaatcaaaaatcctcaattttttcataaattggccgtcaaagccagtattactagagccgttgctattgctgtccaagaggtccttcaattcttcgttgtagagttcaatgaacgaacattttactacgtaatcgttctgttgtagttccaatgtgtcaaacaacttcaaaagaaccctcggtataattcctgctgcatcgctcaattcaccattatataacttttcgtcgcccgtcattgtatatgttttacctgttgacgtcataccatataccagtacggtgcaattgtaacctttaatgaaatcctggaataatgggcccgccacttcatcaaaaattagatcctgggaagcgccgggaccgaagactttgtccactgtgtatctcttggcattcatttgagcagttataccggtatctcccgtcgtgttaatggaaatttctttagaacctgtaatatctggaacatttaccacaacggagcttttcatactaatttccctttcattccttcctctgcatcgcacagctacagtgatgttcagttcctcattaggaacagtgtgacatccaacctgagagttgccatttttactgatgctgttggagcttctatcttgacccgtattttggttttccgctggcatcaaacaaattctttcttgttgtattttttgcgcttttatatactttttattactttttcctttgaattgcttgcttctgtatctatactcaacgttactttctggccataccataagttctacacccgctgttgagaagcgggtcacaaaggaagtctttagatgatgttattgttgcggccttgtttgtttgttttgtttatttcgcgtacctaatacatcgtcaccacacacgaaaacgaaaacatttgatcagataagtgatctgcaaataagatataataaaagtaacagttatttatttaattaaaaacgcaaatatgtagtaatacgtgggacatataaatttcatgaattaaaaaaaaaaaatgaaattcagattgaaaataatggggatataaaaaaagtggacaaacgatagtgaagagggactccgacttgtaacctcgagacgcctaaggaaagaaaaagaaaaaaaaaagcagctgaaatttttctaaatgaagaattaaataatattcaatttatcaagaatatctctcacttgatcaaagattaaatcggtctttgatccaatgaattcatccatgttcaattcttgcttgaaaccagatgaatgggactttttggtatcattccagaaagcggacaaatcttgaccaccaccgttgtagattaaaacatttggagtgtcttcagggatatcgaacaaaatgtcctttgtactgtaatgaattagcttctttttcaattgctgaggagtcaaagaatcctggcccaattcgaaaaattcactatcagaacctggttgcaaagacaaaaagtaggtcaacaaaccagcaacgtgaggggaagccattgaggtacccgataaagtggcggtggcgtcatcacttccaatgtaggtggacaaaatgtttaaacctggggcgaaaacgtcgacacacttaccccagttggaaaagtaggctctgtcatcgctcaacgtggaagctccgacggtgatggccttgtcagcagaagctggggaggtattacaagcgtcttggttttcgttaccagcagccacggcaaagtgaataccgacttcaacggctgcattaacagccaagtccaaagctggggacttgccaccaccaagcgacatattggctgtggaacctttgaacccctttttcttttcttgggcttctttttggtgcgcctttgcggcatattcgacacctttgacgacatcagacatggtaccagacccgtttgatctcaagactttcaccgcaacaacgttggcatttttagcgacaccgtagtgtttggaagcgatagtaccggcacagtgggtaccgtggccgttaccgtcgagatcttcgtcgttaagtgggatggttttcccccaaatggctctcttttcgaagtccttgtggttgatgttgacacccgtgtcaataacataggacgtgacaccgcgaccggcatcatcatcgtagagatacttgttgaaggaccccaggttgaggcgctctctgtgggaaatacgggccaacccccatggggcgctattttgagtgtcaaattctgtagcctcgacaatagagtctctctcaacaaagtctactaatgggttttgacgtatcaagtcgacaatctcttgggtgaagtaaccgatgtaaccggagaaaagattatcgatgttgaatgagtcctggataccgccagcctcagaggtggacaaggaggtgtctttagtagaaatgaagaaagcgtcttcggcagataagttctctacggattgaagttgtgcctgctggacgttttccttgtggaaatcgatctcttcttgaggggcacctctcttgaagactataatgtagcggttggggatgatcttggagatcgcgtctgggttgaattgtgcagtggacacgagaggagccagcctgttgtggtgcctccctttctccaacgtcttttcgtggtgcttcttgcccttgactttcttacctttcatcttcttctcctccaccttattttcgtggcagccacccttatggtgaggcttcttcttcttatcatcattatcatcatcattggaactttcatgcttaggcttcatgccctttcctccctcgtgggcgctcccatgagagccacttgcacgtttaccgttgaattccggagactccttgtcttggcccttgcggcccttcttatggaactttccatgttctttatcttcagagtcagatggctcctcatcatcgtccttagtgaattccacttttctgggtctctcgtggtgatcttccttgttaatcagttcgtggtggtcggcggcattttcaagatttgggatgaccaaagcagcagagatgctccctagggcaccgagtgtaaatagagtattttctaacttcatctttgcttgttagaattaggtttagtttgtttttttattggcgatgaagctaattggactcttaagtttgtatgggaagaactccaatataacgggacgtaacattggcccccttttatattcatcgcgctctttatcgcgggtgtgtttgcccccgccactcccgcagtcctggcgtgataagccactgcagtggcattactgagcccaaattttgctttttcaacaagtcacctaaatttccaaagccgaaagccctgctactctgctaacccggagcgtttaaagtccacggacatttcccagccctcgttttttctcctcccgggaccccgggcataagtgcatagtaggcacagacctgatctgtcgggtgcagtttaaaaaagtcttggcaaaattttttatttatcacactactgtgctatatagagtatatgtaatttttaactattggtatatgtgtccgtgacctcgtagttagtggctgatttgtcgggtgcaatgcagtgttcaaaaagcctcttaaaaggcgagcagacgtattcggctcctttgaattggcactcccattgcacaagctctttcagccggcagttggtttgtgagtcaagcgttgctaacggtgcgagcgcttggtccctagtgcggatggtggttggaggcgccatgagggttgattgtcttatctgcgatagatgagtctttctttccttctcttttccccttttctccccccctgtttctcgtccatctctatctgtctatctgtcttatctactgttagtttttttttcgctttcacgataccgcattacgtactgcgctgcggaagtgtggatgagtggcatatacactcttctgcagaggattttcgtacacaacggtgtgtgtgtgctgtgaagctgtctgcttccttacttggctgtttgcttgcttgtgcgtcatggtcacttttgttagaagtgagccgcataaaatggcatgtcggcacagcctacagttaaaaattaagcatatctgactgtttatctgtttatctgtttatacacggtgaactgtcacgagaacccttacttgcacgattagcagattgttcagagagcctcgctcgttgaagttcttctatatgccagcgtgtttcatgtagcaggaaacgttgctctatttatatcttttctgacattttgcgtcgtcgggaaaaaaaagattaagtaagaacaaaaaaccgttaatggtttcagcaatcgagacaagtacaaggaccaaggcaaaggtcagcagtaagcttagagacgatgaaggttgattacgagcaattgtgcaaactctacgatgacacgtgccgcacaaagaatgtgcagttcagttacggtacggccggattcagaacgctggccaagaatttggatacggtgatgttcagtactggtatactggcggttctcaggtcgctgaagcttcagggtcagtatgtgggggtgatgatcacggcgtcgcacaacccataccaggacaacggggtcaagatcgtggaaccagacggatcgatgcttttggccacatgggagccatatgccatgcagttggccaatgcggcctcttttgccactaattttgaagaatttcgtgttgagttggccaagctgattgaacacgaaaagattgatttgaatacaaccgtcgtgcctcacatcgtggttgggagagactctagggaaagtagtccatacttgctgcgctgcttgacttcctccatggccagcgtcttccacgcgcaagttttggacctaggctgtgtcactacgcctcaattgcattacattactgatttgtccaacaggcggaaactggaaggagacacagcgccagttgccacagaacaggactactattcgttctttataggagccttcaacgagctcttcgccacgtatcagctggagaagaggctgtctgtcccaaaattgttcatagacacagccaatggtatcggtggtccacagttgaaaaaactactggcctccgaagattgggacgtgccagcggagcaagttgaggtaatcaacgacaggtccgatgttccagaactgttgaattttgaatgcggtgcggattatgtgaagactaaccagagattacccaagggtctttctccatcctcgtttgattcgctatattgctcctttgatggtgacgcagacagggttgtgttctactatgtcgactcaggatcaaaatttcatttgttggatggtgacaaaatttccactttgtttgcaaagttcttgtctaaacaactagaattggcacacctagaacattctttgaagattggtgttgtgcaaactgcctatgcaaacggcagttccaccgcttacataaaaaatacgttgcactgtcccgtgtcttgcactaagacaggtgttaaacacttgcatcatgaagctgccactcagtacgatattggcatttatttcgaagcaaatggacatggtacgattatattcagcgaaaaatttcatcgaactatcaaatctgaattatccaagtccaagttaaatggtgatacgttagctttgagaactttgaagtgtttctctgaattgattaatcagaccgtgggagatgctatttcagacatgcttgctgtccttgctactttggcgattttgaaaatgtcgccaatggattgggatgaagagtatactgatttgcccaacaagctggttaagtgcatcgttcctgataggtcaattttccaaaccacggaccaggaaagaaaattgctcaatccagtggggttgcaagacaagatagatcttgtggtagccaagtatcccatgggaagaagctttgtcagagccagtggtacggaggatgcggtgagggtttatgcggaatgtaaggactcctctaagttaggtcaattttgtgacgaagtggtggagcacgttaaggcatctgcttgaaagcattattcgatgtatagtatagctatttagatatacagagagataaatgaaagagaaaaaatattggtatcaatcaacgtttgttacaggcttagactttggtttggtaattgaaattcatggtagtggaaataaacaaaattttcctcttcaatttttttcgtcgtttcgctctgcaatcgaaaatcaaataatcttcataaaagaaatcactttcaataaatgaacttctcactaccataatggatgatgtggccgattcgaaagcaatacggttgattaacacggaaaccccgagtgataagtcaccaaaaaaaattctctttacgatgaatgttccgaatttgttctcctctttacagttttcgttggaaaggtatttatatgtaatttccttcagaattctcttgttttctatgttggcattgtcgagatgaacctgtttcagtatggcattgggaaaaagtgtagcttgtaactttaaaacttgatcatgcagtgttgcagctaaattatccagagtaaaaatttcctctttggagtaaatgcctagcaagtttttcagctgactactccaacctcgcctggccctgtgctttctacttacacaatctttgtgatttggtggtaaggtttttggaaaatgaggaagagtatctagttgttgggtaatgtttctttccaagaatgatatttttttcattatgacgtcaatttctttagaataagccgagaactgtacagttttaaaaccctttctgttgtcattcctctgaatcccatcatttgccatttaattttcaatttagttactagtcaattttctttttcgccttttgtattccataatatgaatataagcttgggcttgccgattttctccgcttaatattaagcctacgcatgatgtaggttacattttgaagggtttcttttaacttccttacttatttatatatgtatgaacctacacaaggcattttacccttatttcttcccgcaacatttgataaaaagtggaagacgtttgtgattgttattatcgccccaattttctcctttttttcttttccttcaacgtcaatcaattgcacattcagccgattggctttcttagcgcaggatagggtgtcggggatacctgtgggaagttagtgacacttttttttccactctcttcatggaatccccggacggcagccgcccgtcccaattttggcaaaattgacatcctaactgcacgaattctcatcgcgtatcagaactcttgagccttcagttttactactcaatgctctgatttatctatatatacataaatgaaaataatacgtgcgcatttataagacaaaaagttagaattctgaccacgattgcatgctgtagataattgtcgtgttcattctctctttaacggcgcctcaagaagaatataaaataattgctcttgcagtctcaatgagtcggtatgttcaaagtggtgcccaacatttactaatattggactgcggtacaaaatcggcggctaaactgtctaccgataaaatactcttgatttataagaatgaaaaagaaaacaaaaagggatgacccctgaaaaagtttgttttctttacccttttttatgttaaattttacatttattaccgtttacgtcaatcgcaatatacaggtggggcattgttatttgatttcataatctggtgagaacgttatcacgcggattatttagtttttttaaaccatgtgcgaagaaattctcatatattgtaggcatttctgactcaaacttctgctgcttaaaatagctgttttcaccttttttttcctcttgttctatttgacatgctccctttcttcctcggtcctttcaaccatttccatgctcctgtaggctcaggagcagagcgaggaaaaaacttccctacagaaagctttcatgtttttaaccggtttcctttcagctttttcttttggagtaatctagaaagattaggtcatttgttcagtctatttgatacttgatgagtagctcgtctgttctgttcaaaataacaatttgtgaggtgtacggatgttttcactggcattcgtcgacatgacaaagacaaaccttgaaaataataatggagaataactagaaagacgttactatgcctctaatacttctgcctctcttatctctcctatcaattgtggttagcctagtagtcaccaaatagcaaattaccaatcaactatggaaaaccaagagaaaccgctttctgtagacgaggagtacgatttatggaaatccaatgttccattaatgtatgactttgttagcgagacacgtttaacatggccatctttaaccgtccaatggctccctactcctgttcaagaattagatggtggctttattaaacaagaattaatcatcggtacgcacacttctggtgaagaagaaaactatttgaaattcgcagaaattaatctaccaaaggaaattcttagtaatgaagacccacaagaagaagcaggagaggagtatcagtcctctctacctgctcctaggtcaaatataaggattaccgctaaatatgagcacgaagaagaaatcactagagcccgatatatgcctcaagaccctaatattgtcgccacaataaatgggcaaggcacagttttcctctattctcgctcagaaggtcttcagtcaacactaaaatttcataaggataacggttatgctttatcatttagcactttggtcaaagggcgattgctttccggctcagatgatcatacagtcgctctctgggaagtggggagtggcggtgaccctacaaaaccagtacgaacttggaatgatttacattctgatattattaatgataataaatggcacaacttcaataaagatctattcggcactgtttcagaagattctctcttaaaaataaatgacgtcagggcaaacaatactacgatcgatactgtgaaatgcccgcaacctttcaacacattagcatttagtcatcattcctcaaacctccttgcggccgcaggtatggactcgtatgtttatctatatgatctaagaaacatgaaggaaccattacaccatatgtcgggtcatgaagatgcagtgaacaatttggaattttcaacccatgttgacggtgtagttgtatccagcgggtcagacaatagattgatgatgtgggatttgaaacaaattggagcagaacaaacacctgatgacgcggaagacggcgttcctgaattgatcatggtccacgcaggtcacagaagttcagtgaatgattttgatttgaaccctcaaataccttggttggtagcaagtgctgaagaagaaaatattttacaagtttggaagtgttcccatagtctacccatcgtgggaggtccaccaaaggtgaacaaggatataataagctaatatatagtttttttattgtttctttggcgaaaaggcgtaattaaacaaagatcaacatacataatccgattttgaggagtgataaaatatacttagattattccttatccattacagtttgcttttttgaagatagccaattgatgaaatcaataaaaatgttaggtccacattttcctttttgcatccactctttggtagttgcagtatacaagtcaatcaattcgtcaagcttgtcgttaccaccgatttcaacgtataacttactcaaaaacagtgagctggttgagcacattgaataaaacactgcagcatgctgacctggcttagaagtcagcatcagcttgtgtgtttttttcaacaaatccataagctcgatgtctttgttcatgtctttgaatgcagttacttttatcttgaatattttacccttcaacaatttagaaattttgtcggcaagtggcctatcaagagtttcattgacacatttcagcattgggataataaaataaacgagcttgcttaatgagcctcctaaattgttggaatgttcacttttattagcaagagtcaatttttcacaatatttgacgtaaacggctaacatgtcgacaactctatgcttgaacgagataacgttttccctagattgttttacctcaaatttcctctggtttccagtagatatgcttgataatgcttccttacgacgtttgaaaatttcggataactgatcatctaattccatcattttttcatcatccatagactcctcatcttcatcgtctccaccgtcgtcagaaagcccttcgagttggtctaagtcaacttcccctttatcattaactatgttatcgggtaaatttaacgccttcactaaggcgctagtggcctctttatcaatattcaaaatatcttcatttgcctcgtcttcttcatctttttcatcagcatcatcgctatcactctcactttcactttcactttcactaccagttttcgattcgtcttcactggcatcattttcttccttaatttcttcaaattcttcttctccttcgaatagctgggcaaaaccttgcttgttttctctcgcttttaaaatatctaataaaatttgcaattcttccaaaccaacttcttcaataaactgctgccagattattaaactcaatttcctgagtaaggccttcttttgggctaaaagtgatagtaagatttcagtgatgcctaccattgagttattctcgtgtttggaaaattcgcaaagttcttcgatcacagaaatagaatcggtgtcacctgcatataattgtactaagcacatagataacaacgtgcttagaccccaagattgagcagttcttgatctgcaaactttactcaagcaagatatagcttcgttttttatattttctaaattttcgtccagtggattgattaaatctcctacatgagaattttcaatgtccagtattaactttaatgtcagatattgccatgagtttatttcaggatctttgcaacgtatttctttgtttattgtcaactctcccaggatggaataaagtctttccttggctaattcgtgtagctgttctaacttcagatcatctgatgtatgtttgaagaaagccatatatacgatgggtctcaacacgggcttcattatgtccatgtcattgatttcgactttgtgtgcacgaactatatgaaggatggaatcaagagcaaaaagggtatgagataaaactccctttttatcttgtaactgtagaaaaaacacatcgagtaattgggcaagaacagtagaaggtaattctttaattgcaataagtttggaaacggtgccagattttgttaacttatcaaagtttatggaaccgtgaggaccaaataacattgcatttaaacaaggtactagtctgtttgcagaatcttcttcacaagccttcactatggagtctaaagttaactgggaaatcttatttaaaactctttgtgaatctattgattggttgatcaatgttctcataacgttttggctgaagcaaaacccgatgtacgagccaggaactgccttgaaagccgcgtcgattattagaaagcctaaatattttctttcactagaagctttctcattgaaaaatgattcgtccacggccattttccaaaactctggaaattgaattgaattctgaacctttttattgttggttttcttccttttcttcgaaatatgactagtgttctctaattttccattaccaaacaacggtagcagaacactccaaacaaaatgcagcctagggttccaattcgtgtttttttgttttttcgtctcttttaaacctccattggcatccggaattacagaagagtttctcaatacttttgttaaaaggggcagatttcctcttgccagagggtcgttatccttccaacctggatttttcaaatccaacaccgagggaattagactttcatcaccttcatatttcagcaacaaataagttgacagtccctcatttgtcagagtcaggtcatatttatcatatatcagaagaattttttcagcggaactttcatccataaaaggtagcagcattttcatagtctggaaaagggtaaaaaagcatggttctttgatccagtttttcttcagggccagatcaattagctgttccgtgaatcgaatgaaaaactcggtgtttcctttttccaaatctttaacaaatatttctgagaataaaggttcatttagtagagatttcaagccaaataacttcccaaataaaattccacgctcatctttgcccttcatggatttttttgttccctcattgacattaacgttcaaaatggttgataaggtgctcaagaactcgttcgttgattctaaaccttttggtcgttgacctggtggcatattaacagctaaattgattacttccgtcaaacataaagaaaatcctaacctcgcgctatttctgtcagacgacaaacccttgattaaacgattcaatacataagaccattcttctgcatcgtcgggcaaatctaatgcggataagtcctttattaatgcgacagctgcatgtagacgctcttctcgaagatcagaagctagtttaaaaaaaaggtctctgttgactttccctgtcattttttttgtggacaaaaagatgcacttgtggaaagaatcacccttgttaatggatacccgattcaaacttcgaattaagtgcaaaccgcagcctcagattaatgttaaattgccctctaaggcaattctggccatcgcaataaaatttttcgtgttattcacgctttaaaggccgggtaaaatgatagcgtccgttgattttgaagactattacttttgcggatattttatgtccggtctatcatatttaccaatgcaaaataatattttgatagtttttaccgcagaggcagccagtaagttgggaagttgctcagacccatagatacatacgcaggaaaggttttgttttcctcctttcattattgcaattaacgtatacataacttgaaaagctgatgggtgtcaagcacgcccatcagcgcatctgaaagtagccttgaaggaactgtaagtttccacttttcgaatcagttattggtcgtcaaccattagcagaagtaagttcagatatttagatataccctccctcaactataacgattaacaagtgtttacgaactaatgtaacagaccaatcccaagagagtacgtactaagagaaaatgtaaggctatgaaatggactaatataaccatagtagaaataggtatatcttagtgagtaatcgcctaaattaatcttgtttgcaatataaattggaactaagtacagtgaaagacatcgatggaaataaaaaaataaccatcgaaacttggtcccagagtgttgtcaaacgttcaagatggtttcttttctaataaaaagcaaattagaaaactatttcacaagttagtaataatagtaaagaatcaagcatggaaagcaaagtaagaaaaaagaatgaagtgaaaagcaaaaaaaaaaaaagataaaaatgaaaaaacaaaaaaacggagggtataatcacatgcagatataattttcggaaatacattatagaaatataatgtgtcacttatcctcttcattgtggttatccagagaggaagagaagagacaaaacagatagaaaaagtataaccctagaatcgaaatcaaaaattagaaaataaacgtattggaattttgtgcaattatcatattaaaatacaaaaacaataaaaaaactaaaaagctttgaaactttctttaatttttttctaattttctgggatttcgatttcaccagcattaatgccttcaatgatatcatggggattcttgaagtcaacacgacagccgacagattgagcagtacctaagatttccttagtaacggaagccaaagttctaccgaaggatttgtctctcatttgtctggcaatttcaataatttcatccaattgaatgttaccactgtgcttgacgtttttgtccttctttctgtctcttggtggttccttcaaagcagtaatgaccaaagaggaagcagatgggacaacagaggcagcagcttgtctgttttggatctttaattggacggtaaccttgatacccttgaattctttggtggccttagcaatatcttcaccaaccttctttggcgatagacctaaaggaccaatctttggagccaaagcagcggaggcaccgacttcaccaccaacggctcttaggtacaagtatttaacttcattaggatcaaactttggaggcatttttgtatatcctttgttcttgttgtcgactttctagaccccaaaagaaagttcctttaaggtgtaatagtaacgaactgtaactcaaagaagccttgaaatttaccaaaattctagactttgaataattttttcagtattaggagatgtccatttccagcagtgttaacggattccaaattttcttccgggattttcccttcggttaccaagagtgtctctccagctctagggagagcccaggagtaattgccgccgcgtccgcctaagtctaggcagcaagccacaactgtacggacggaactcccagccaagtaagtttggcccgaactcacaacgggggaacgcactgcattttaccagcttacaacaataacgccgttgtaggcggcttgtaggtacaatcgcaacgatatctggagtagatggcattgaaattgagctgatactgttatagtttacaagcagtacattgtctcattacattgtctctttgtttgacacccacacatatttggtgttcggatgttaaacagggtatttatcttgttttagactggtacgaatgggataatggcataaggtggcttcatttgtttgagtataaaggtctcctttataataattaaatagcgggtatataatgctaaatatattttgtacagttagggtaaattccagattatttatagcggtcttgctttattctcaatgtttgtatggggaaatagttccatccttctgttgtatgaactaattcaaccttgtattcgtgggagtccttgtttttaatgttctttttcaaagtgttgacgataacttttgagttgactgataatgctttagaagtatgttttagtttacaatagtactccagagagagctcttgaaccagtcttgttcctgttactagaacgccgttattatcgcctcccttgattccttgcattatctcatcaatagaactaacgacattgcgcacttcagtttcgataaagttagtggccctttctaactttatatcaaatgcagctcctttttcttcaatgacaaaatcttttaaagtttgttgaaatacttcatattctggtaactcaggaacaccaattgaattaaatggcttgaatctcaaattatggattaaccgttcattagagaattttgacggagtactattcttgttgtcaattaaaccaaatgactttaaaattgcaaattggaaaacctctattagacataaagatttggtaatgttaatttccttcaaaagatagtttaaaaattgtttggtagcttgtaattgttccatttcattatccatagcaaacctgtactttagcctcaattggtccttcttttcaccagctttcaattttttaagttttttgttcatggaatgaatggcattaatatttgattcaatatcattttgactatctttcaaaaaggtttctaagtggtgacttaaataataaacataccaaaacatagagtatgcttcaaagggtttgtaaatatccaaatcaaacccctttaaagagaattcgatcatacttgatagtttcataaaatatgtccacgaacagtaaacttgtgaattgacactttcaaactgggcttgaagagaatcccatagaataagttgcctgttaaaaccttgtctatatctacatgtgttttgggagcagttttggtaccattctaaaagcatattagagctttcttggataagttcattaccaatagaggattcaaattcagatggagtttgtgctgaaaactccttgacatgtagcaaataaaattgggtatatgaaaatttacccaaaactgttctgtcgtctctaatgaaaaataaggggaataagatccttgcaatgacatgcctttgttccaacttgttgaagaatttggcaaactggtaggtctccaacgcagactcggctttatctacaaggagtattgttttaacatcatttgccagtgtaataaagccgctgtaatccgtcggtaacttcgtaatcttcctgggagggaattgattagacctgtgcttttgtatatatgttgagaacgcaccctttggtggagacagctgtaattgtggaaatatgccattaaccgagttagcgttttcaattagctcatccaggtggcttgtctttgtggaatagtctgtcagatggtcttctaagtggactaagcaaatgataatttttagtatatgcttcagcatagttaaatgtaagctatcatcagaatatgcctctaatatctgaaggctctcggtgagagaattgataacaacatcttgccccggcaaattatcgaatgtattaaaccccatgttattaaaatttaaatcctcctcttcaaaaacaataccagcactcaagagtttctgcacaaattttgttaaataacaaacgccaagtatgcaacttcctagtactttatcatacaaaatattccctgtacaccaggacgaaccggcagttgttcccttaactaatgacgataataagctttctgtatacctgcagcttaatacagtagtgggtaaagtctggtagtcattcagccaggagataacacatctaagtaatctatccgctatggctgctacacttgccaacggtggatcgtaggccacgttcacatcaaattctatttcttctgctgtcaattctatcagactggagtctaatttggagttgttgacctctaaagaatgtgtaccctcgaacaaatcaaacctgggatctttcacgatagcctctggttttagttttgaacacaattcatcaaacagacttgtgacgtcaaccaattggtcaaaatcatcagttatgctcaaggaacctaatatactgtctacttccattctcggaaacgtaccagctattatcaaagttgctctacactagcacagttgttttcaatctcagcgccactcttcttgctattgaagagctgctattttacttgtatctcttcgtgaaatttcactccatctcataattattacccgaaaacataacaatgtgaaataatcgtattatgtaaaggttagataatataacaactactagataatacagtactcttattcatttatttaggcacctgattccactattacctattcaataggtgtgccgagttcctttgtcttacgtaattttacacatcttttatgggtcatatttcgatatgtaaggtaataacgggaatctccggatttactttaaagtgggagggagaagttcctttcttctgatttgcgggtgctccgaaagaacaaagaataaataggtaaagcagtgaaacatagtatttgctggttaaaatcatgatcgctttgaagcccaatgctgttcgaaccttccgacaagtgcagcattgcagctttcgcatttgtcggtatcaatctacgaagtcaaataagtgtctgacgcccttgcaagagtacgacagactggtgaagttggggaagctacgggatgatacatatcagcgtggtatcatctcttccttaggggatttgtatgattcactggttaaatatgtacctccggttgtcaagacacccaatgctgtcgaccaagttggcggttggttgaatggtcttaaatccgtatttagccgtggcaaacctaagaacattggggcgtatgtggatgtatccaaaattggtaactcgatacctcgaggagtttacctatatggagatgttggctgcggaaagacaatgttgatggaccttttttatactacaattcccaatcatttaacaaaaaagagaatacattttcaccagtttatgcaatatgttcacaaaaggtcgcatgaaattgttagagagcaaaatttgaaagaactaggtgatgcaaaaggaaaagagatcgatacggttccatttttggccgcagagattgcaaataattcgcatgttctttgttttgacgagtttcaagtcactgacgtggcagatgcaatgatattgagaaggctgatgactgccttactatccgatgattatggtgtcgtacttttcgcaacctcgaatagacatccagatgagttgtatatcaacggtgttcaaagacaatcatttattccttgtattgaactgataaagcatagaactaaggttatcttcttgaattcgccaacagattaccgtaagattccaagacctgtgtcctcagtttactatttcccatccgatacgagcataaaatacgcatcaaaggaatgtaaaacccgtcgagaaactcatattaaggaatggtataactatttcgcacaggcttcccacaccgatgattccactgattcacacacggtgcataagacattttatgattatccattaactatttgggggagagagttcaaagtccctaagtgtaccccacctcgagtcgcgcagtttactttcaagcagttgtgtggtgagcctttggccgcaggagattacttgacgttggcaaaaaattttgaagcctttatagtgaccgatattccatatttgtccatttacgttcgtgatgaagtgagaagatttattacatttttagatgctgtatatgacagtggcgggaaactggccactacgggtgcagcggatttttcttccttgtttgtggaacctgaacagatacttaatgattttgagttacgcccaacaaccaaagaacctgatagcgtcgatactggtatggtagatgagatggttgagaaacacggtttttcgaaagagattgccaagaaatcgcagatgtttgctcttgatgaagaaagatttgcctttgcccgtgccttaagcaggctgtcacagatgagctccaccgattgggttactaagcctacatactaaaccctatgtaacaaaagtgtttatttatattcttgtatttattctaaacacgaactttgatcgtctaacaattgccgcagttacacctttaacaatagtgctttttattactgatattactcacctgattttttgttacccgaatgcaaatttgattaggaacggggattgttaaaagacaatggcagtacagataaaggttagatgaagcagcagtagaataaatcagcatctgtagtacataggttcctaacagcattgtgaaaaaggttcaaaaatgtctggtaatagagagcaagtctttcctacgcgtatgacgctgggtttgatgaagaccaagttaaaaggtgccaaccaaggttattctttactaaagcgtaagtctgaagccctaacaaagagattcagagatattaccaaaagaattgatgatgctaagcaaaagatggggagagttatgcaaactgctgccttttccttggccgaagtttcctatgcaacaggtgaaaacattggctatcaagtgcaagaaagtgtctctactgcaagattcaaagtgagagcacgtcaagaaaacgttagtggtgtgtatttgtctcaatttgagtcctacatcgaccctgaaattaatgatttcagattaactggtttaggtagaggtggtcaacaggttcaacgagccaaggaaatctattcaagagccgttgaaactttagttgaattagcctctttacagactgcatttattattttggatgaagtgattaaagtgacgaacagaagggttaatgctatcgaacacgttattatcccaagaactgaaaacacaattgcttacattaacagtgagttggatgagttggacagagaagaattttatagattgaaaaaggtccaagaaaagaagcaaaatgagactgcaaaattggatgctgagatgaaattgaagagagatagagcagaacaagatgcttcagaagtagctgctgatgaggaacctcaaggtgaaacattggttgctgatcaagaagacgatgttatattctgaagtttcaggcagaacaagacccttttcaaaaatatgtaagccattattaaaaaaaaggatattttgtataattgtttaataaaataacatctttttaaacaatcataaatagcacttcttatcatacaacctcaaatcatatcggtccaaatttgctcaaattgtacatgagatataactttttcttctaatgctttcatttcagagtttgttttttttttttcttttttttttttttccttaccggagtctgaatctcttacttccttaacttagatgttagtgactaaaatctgatggacagtatcaaaatgtaaatattgtacctaaaaagaaaaaagtattaaagtggtttgccataaattttaaacaagtgaaaagtttcaatatttatatttacatgattgtggacaagcggcattgtctacaggctgtgcaaaattatatagtacagataaatgtaaccagaacaacgaagaaaaggtccctatgttgcttcttttctactaaaattagcctatttataatcttgcatctttgcctcttggtctgtcttttactttcattctattttgatttttaccccttctagtcttgtacccctttgccagttgtccccatggagacattgataatttattagacttggatttaccacggccaccaccgtgaggatggtcacatttattcatggcaacacctctaacagtgggtcttatccctaaccatcttgatctgccggctttaccaagagatctgttttgatggtcaatattggagaccacgccaatggtagcgacagcctctaaagacacataacgatgttcaccgctttgtaatctaacaatagctttctttttttcaggtaatttcgcaaggactctggcatatgtaccagcagagcgacaaaattttccaggtccaacgggtgttatgccaacgttgtgaataatagtacctatggggatcatggaaataggtagacagttgcctctttgggtagtcttaacactcaagatagcagggtctactttcccgcccatttcattcagtaaagtttgaggaatacctcttctgaaggattcgaccacatcgcctgggcgtaacccatcacaagcaataatataagacaattcgccggtagtattatgcttcaatagggcgatatgagaggatctacccggatcgtactcaatcctttgcaccgtttgtgcaccaccttcccatctgttaaagtctatcagcctcgttctatttctatggccaccaccttggtgacggacagtgatttttcctgaattatttctaccaccgtgcttctttcgaacaacagttagggctctaaccggacgacctttgtacaaatatggataaatgggggaacggtaccatctcaaaccaggtgagacgggttttagcctcttcatctgggtcacttctttcgaaagtttacgacgtcttttaatcaattcatcctgcttctcaagagtcacgatatcagtatcgttaggtataatctttagtaatcgtggagtaatgttcaaactggagtcatcttttgaagtattctcttgccacaatttaacactctgagatagagttcgacagagtataccgtatggataacaagggtttctcttactaataagcgatgctgtggaactgcacgacagcgccgatctaagagaccctagcaccaacatctttcataaacacttaaattatcttctctgcgtatttctggactagtttacaacgttctcttttgcttagttagaactcgctttcagtttcccatacgttccctttctctttcaattataggttcaagccctaactttccacctcgcgtagtcttttttttgcatggaaaattttttttgagtatttaaagaacagaggttctattcaaatttaaccgtagaatatacttattcatcttaaataccaagcgcttcaacctgtacgtggatggtaacatatagatatttctatagaatgtgttaaggaacaggagttcctgacaaacaaaaatagatcgtactaatactttttttttcgaactatactgtttgcgtatgcttataaagccaagagggggatgtttgtgtattactttctttacttttttctcttctgcattattgttcctttagagatgataaagacaacttacaagtacagttttttgttggtatctcattaacatgatgactaagttgtcgccccaagcggatctttgaaatgactgattttacaaacaacaaacactgaaaattctgaaattaatgagatatttacacattaaacatcaaaagttttctcaaggaacatgtatttaatgcaagaaaaggattgctgaagaaaggaatcttttctcaaacattttacctcttttgcctcatttgtacacagcggtacggttggattaagaaaaatatccattcgacctagttttttttgttaagcacaatttggtttcaatatcaattcttactgttatataaaaaattgtcttaattgccattatcactcctctttttttttttttttgatgatgattacactccatgctaatcatgaacgtgttcgatgtaaatttgaatacgatgattaaaattgttgtttacgctttctgaaatctaaactagaaaagaaaaggaactatcaaagaattaggctcttcgtattggaattagttgacagttgctcatgaaatgaatggattaaaaaaataaagctgcgcaagcccggaatcgaaccgggggcccaacgatggcaacgttggattttaccactaaaccacttgcgcttactatttgttgttattcaaaaaataaagaacccacagaacatagattagaacataaccttggagtatcaacttgattcacaaaatattattcgtcgtatatcatggcatatagaatcttgctggaataagaagcaagtttcatctttgatcttatgtatatagtattaatatgtattattgttggaataaagatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtacattctacatacctaatattattgccttattaaaaatggaatcccaacaattatctcaaaattcacccactcttcaattatcatataggacagaattagttgacaaaaagtacgatgggaaacagctatcaaatttaaaggaagctgaaatgcaagaattaataatgtaatagggtagcgaacgacaaagtataaaaggaaggaggatgaagttacataattatgtagcactatcgacttccttttgggcatttctataatctcgaggaaatcttctagtatatcctgtatacctaatattattgccttcaacacagacggaatcccaacaattatctcaaaattcacccatttttcactctcaaatctgaatctaagtaaatagtggcagtgaaatccggatcaaaattcagtaacttttgtgatatctcacattgacataccacggtcggaggtgaatttcttcaccattaacatataatatgatcatctatgtaaattttattgctgttattctattagtagtaatgatcgaaaatagtagaggtatcaacgaggtcaatggatcaaagaatgccttgaacctggttagtctataaattttcgtttacctacgtatgtcatattcaacgttctttctttctcaatttctgcaatgatcccaccggagtatatgaacgaactattttatcattatagctagctctaaacggctgcaaaaactaattccttgaaacaatgtgccattaattatctaacgcgtgcttcgtcctactgattattatcccttattcgtttgattcacatagtagacaactcttgatcacccatatagtaccagacgacgctaattcaaaattaatcgacattacgcatgtttctaatttgggaaaaaaaggccaagctccgatatcccgtttaaggtcaacgcttgaacagtggtttctgaacgaacactcatatcatattacttcgactcaactgctgagctagcagactggaaatatttcagggactcaaaaaaggttcaactagtctccactgtaagcacattcttgcattctgaatatacgaatgagtatcattaactcaaaaccgcgccctcttatacgagacctccaaaaatggatcgttcatgagtaaaggcatctcaataacaatagcaataacaataatgttcatgaggtgaaaggtggcccctcgttcatgtaagagaagctggccgagaaattcatataaattgaactgctttggttacctctctttggtatatgcctccactcttctcttcctagttaagcttatatcagcacaaacaaaacaaataaaatggtcaaattaacttcaattgccgctggtgttgccgccatcgctgctactgcttccgcaaccaccactctagctcaatctgacgaaagagtcaacttggttgaattgggtgtctacgtatctgatatcagagctcatttggctcaatactactctttccaagctgctcacccaactgaaacctacccaattgaagttgctgaggccgttttcaactacggtgacttcaccaccatgttgactggtattgccccagaccaagtgaccagaatgatcaccggtgttccatggtactccagcagattaaagccagccatttccagtgctctatccaaggacggtatctacactatcgcaaactagagacaaacgccaatttaatgaaggaaatgctatgaaacttagataatgaaataaaaaaaaaccctttttttttttttggtagtataaatatctttatacgtacatacgtgaacaatcacatcatatctgtcaattctcgttgtaaccataacctagcacttatttcagactttccaaaggtcgcagtatctttatgacgagccatcccatgtaaaaattgccgtgccggatatgaagtgacaaagatcagtctatatctcggaaagccaacaaatatcttcattatgaagtaacgtatagtgattgcttccacatctgttcaattcggacaattttcgttagcagtagagtcaaagcgatcgccttaattgtctccgtatcttatttattcatgaacagcatgacaattgacagtcacttgaatgaagtagaaagtttgattgtcacggtcatctgagatatactaccggcacctgatccccgctaattaggcaaggcgaaactgtcaccaagttggacatattagacattaataacttctctgaatcgctctcactccaaagcagtgacattaaattttgctttcattcgtgaaagaatcgactaataaattatcatttataattcaacttcagttgaaataaacaactcatcaaattttctttccaagctttttataatggacttttcgtcaccgctaacaagtaaaggattacatttgacacgtatatagatttttcttacggtttcgaaaatctgattgattgcttcaaattcatcatcagctccacttaggcttttttgttcaaatccaatgacaatcttcaggcccgtctgcttaatcaacatagcaaatacagagacaccttccaattgaaaaattgacttcagaagaggtttggaatctaaagaatgccattcaaccaaagcactttcaaaataatctaacgatatgttagaaagcacgttatatttgagtacatcattcatctcattctccgcctcattagggacgtaaatcaatataggtttatcagattcatctatcaatgatacgaagcaaggcctcaagctcatagtttggtgatataaacgtacaatttgatttttggagagaatatttactcaattttcaactcaataacttttatgtaaaatgtttcttggccgtcgatgagctcttccggcagaacttcgaaagtgaaaaaaaaaaaaaaaaaaaaataataataatattaatactacttatatactattaaaaaatcgtttagaaatgattcatttataaaattcgttacttgcggtcattggcaatagattcagctgcggttctcccaaagacaacgcattctaacaaacttgaaccacccaacctattggcgccatgaacaccgccagaaacttcaccggccgcgtacaggccttttagtagcctttcgtcgttcttgccaatgacttgagccttgacattgattctagcaccacccatggtgaaatggacaaccggtgttacttcaccaataaaaaccacagtttctggagtaacgtcagagccaaattcgttgagaataacggtacgtcccaacggatcagccttggtagtgaaggaagagtatgtttgcaattcctcgcataattgggcgacagtgattggtaaattatattcagaaacaacttgagataatgtcaatttctgtacaagtttcttgaacatgtaaaaatctaaattattcttcaaatctgtgtacattttttcgcccataaccaatagtgctctgttatcctcttgaggacaaaccttttgaatagctgcagtgactacatctcttgtggtcaattcgttgacaaatcttctaccggtaatagggtttaataggataccaccaagacctcttaaggattcggcagccaagaatttccagcttgagctacggtcatttggatcaatgaacccagttggatgaacttgaatttggtccatgtcaatcagatcagcgcctaacttctgcagaagcctttgaccatcaccagttgtttgttgcccgtttgttgttggcaagttcaccagttcgggtgcgtattctttaagcatttccttagaaaagccaaaccctccagaacaaaaaacgacatcgttagcactcaccatgtgcttttcgccattcttgtcctcgtacactacagcagaaatggagccatccttttcatggatgtctacgactttactgtctaagttaatcttaactaactctggtttagtctcagctaatttcttcaaattgttagataaggcagaaacaatttcgaaacctggaggcaacttcccagacgatctgtgagttcttgccacagagtggccacccaattgagccaataggtccaatttcaaatcaaattcgtttttcaaccattcaatagccaggggagaatcattggccaacttagccattaattcttggacacctttacctttagcagacttgatggtgtcatcttcaaataagcgtggggagtcctcgatgtggaagtgacgttgagtctcggtgcaagcaccgttaataccactggaggccttgatagagttcccaccgatcgaggaagccttttcgaggatggttacagggatgttatacttgttaaccaattcattggcagcagccagcccggccaaaccggttccaataacaacaacgggagagagagacatttacaattacggatgaggggttgttgaagtgaagataagaaaaaaaaatggggtgctatgtcagcgtattgttctcagcttttatacgtgcaatagattaagctgttcaggaacgcgacgcgttgcccccgttaccgtttgaaaagaaaaaaattttctttttcatacctgtctctattgtttcagtcattcactgcatgatgacaaatgaaagaagaaagacaatagtagtaaaagcaaaaaaggaattaaagtgaacgttttttagactcttacgcatacatataaatatatatatatatttgtataaaaggtgtacgtcgaaatcctgtgaagaaaccctgcgagaatatacatgggtacattcaatcttaatacgtagtatcgtagaatacaaagaaatgtgcttctccacgtggatacgtaccgttgtaaactttaatcaagtaccaaaaaaaccaaacatattcagtcgatctctcaatggggaacaaagaaaagaggttcttacctttttttcctccttccctcagaaagaccaccttcgtccctccataatagggtagttagtcgctaggtgcgctggaaactaaccattggttctcaaatgtgccgacataattagttataattatggtgtgagagttgaaatatccttgaataacaaaacagaaaaaagaaaaaacccatttgaatataaaaatcattgatgcaaaagaaagccgttaaatctacaatgccacgaaattattgtaatgtatgaaaaaaaggaagagggtagcaatcctaaaacaaaaaccctaacaatacacatgatgcaactggaacgcatcagtatttgtaggtttttatttcgcggatagcgttgccatcaacgtcgacctcggtggattcactacggtaaatctgggtaggtccgttacagtcgaaaggatgttctttagcatagtcgaaggcctcggagatggccaatttgactttttccaaagtatctctggtgacttgatagtggaacgagactctaccacccattagcttaacgttgtacttcaaacccttcttaacaaggacatctgggtccattctagcggccttcaggttaataaagacaaagttggtgtctgctggagactctagcgggatgccctttgcctcacaatattcggctaattcatgagccaaagagtgcgagtacagcaattgggacttccaatcgttgttgatgtttacaagagccattctagccatcataccagattgtctaataccaccaccttgttgttttctgaaatgggtggccttcttgacaaacttaaggttcccaaccaagacggacccaataggagcacccatagacttggatagacagatggagatggagtcgaagatttccccatattgctttaatggcacgccagattgtgcagcggcattccagattctggcaccgtcacaatgtagtttgagaccattttccatacaccaagctttgatgcggaccagttcttccaatggataaacaataccgtgtaaagtgttttccagagaaatcaatctggtgggggcaccgtgaatatcaccgtcgtctgggacgtagtgtgacttgatgtcttccaaggtcaagtagtcaccgttggaaggaaccacaggaaccaccatcgcttgagacaagatcgccagtccagcggcttcgtgagtgtaaacgtgagccctgtaatcacatagaatagagtatggaggttgcatcaagtgagttctgatggcaatctggttggacaaagtcccagagacacagaacaaacctgcttctttgccagccatgcgggcaacggtctgttcgagcctaacggtgtcaacatcttcaccgtagacagcgtcaccgatagaggcctctaaagcggcctccatcatctctgcagttggagtggtgaatgtgtctgaccgcaagtcgttagcagcggtgatatattttggaggcaattcgaattcagtcattgtgtttatgtttgcgtttgtgtgcgggagtaaaagtgagtgtaagcctaggaaaggaggtggttacgaactagccagcggaaacaatgtacgtatatgtatgtaagtattactctataccagacagaacaagatagacgagaaggacacatggaggatttgacaggcaagctcaacacttgcttatatatatacacatatgtgctattgcaaatgcaaaaagcgtatatccagtgaagaaaaagacgaaaaaagacgaagaaataaaaagaaaaaccggtgaacgaatatggcaagtgaaaaagtgcgcaatgagtaatacaaagggcgaagcagcgggaaaaaagaaacggcgctgctgcccggaaaccggaagcgaagctttgtggggtacgggtgcatgctcggctttttccagataggggaagtgccgtcgccaaaaaggcaagggtccgtttcgcgtgacatttcatagcgggccaagcgtgggtcacgtgctgcacaggcctgccgctggcatgatttgtcagcacatatacaacaagaagtattggttgcgttgaagaaaaaaagaatagtaataacaatttggggccgtgtgtaaaaaaaataggaaacagctaccccggcgtgccgtgtggctctctgtgcgaaggaaggccctgtcgccgcacatattcgatgaatatcgatgacgacgactaccttctggttgcatagtttattagtctgtgcctgttcttcggcgagtgagtagatgaaagaaagaatgagttagagagaattctaggccaggttcggcttagttaagcttagcttactttgggtttacttagcgtgctttttttcttccgcgctgagacggtgaggaatggaagtgtaaagaagcgaacgagggaaaaaaagttgtgacctaggggaaggttaaaattgtcatcatcatcagcgtgagaaagtcgaaacaatgagcggtagtaggggcaatagcagcaatagtagcgtcagtaataatagtaataataacaataataatgacgggggcgacgagagattgctgtttctaagaagcgtgggcgaacgcaatgaaattggctttccctctagattcaagtcggcgcattacaagaaaccgacaagaagacacaaatcagcgaggcagttgatctcggacgaaaacaagcggatcaacgccttgttgaccaaggctaacaaagctgcagagagttctactgctgctaggcgacttgtgcccaaagcgacgtactttagcgtggaagcgccaccgtctatcaggcctgccaagaagtactgcgatgttactgggttgaagggcttctacaagtcgcctacgaacaacattcggtatcacaacgcagaaatctatcagttaatcgtaaagccgatggcccccggcgtcgatcaggagtacttaaaattgagaggggccaacttcgttctaaaataggcattgtatatgtatgtatgtattttagcttgtagacaacctttcacacttacatagtttgtcgctggtcacgtgcgacaatgcaaaatagtgtagagtaaagctaaaaaggacaagataaagtgaaaaaaaaataataaaaaaaaaaaaggaatattgttaatggaaagcgtgtaaagacacattacgctcctacctaggactaccaacacatgcatggatgccagtctctgtaataaccacggttttagcatgtctgtggctctcttataggctctataagtttctcactattcctgtgtccagcatcgtctccactttgaagatcaaaactccaccggcaacaaaagtgtctatcgacaaaatagccacggattcagtgaccattcattgggagaacgaacctgtaaaagcggaggacaatggcagtgcggatagaaacttcatttcccactatttgttgtatctgaataacacacaattggctatcttcccaaacaacccaaactccctttacacatgctgctccatcacgggtctcgaggcggagacgcagtaccagttagattttataacgattaacaacaagggctttatcaataagctaccctccatttactgtatgacgaaggcgagagaggcgaatgaagcgttaaagactagaaaatggagaagaaacaccatcacatcgtccacagctatgcagcccagaaactccaagtccgaacccgccccgttgccctctcactactcctctgtttccctgtctactttctcatccaatattactaatagcgccaccagcaataatggttcaaatctacccgcttacacatctttgactacgttgaaggatttggattcgttttccatcgatgatctgaaaaagatactgatttgcgcccaggaggacttacacgatgtgttgtcccaacaaacttcgcttttgcaagattttcaagaatcgaagttagaattagaactagaactggataacttgaaaacacattggtcgcacgaaattgacttgcggaaatccttgaaatccaatatcaagtcattggagaattctaaactattgaccgatttgaaaatcgaaaaattgaacaagaaaatcgacaaatccaaggaaaaaatatcgaaaatgcgcaatgatatgcagaaatggtctcaggaagataccgagctgttgtctaaggataccataaaggagaaatatttcaaattgctaaatgaatccaatgcctctgtggccaatatcaacaaagaaattgagtctttacaaaatgaaatttccaagatggaggagtctaacaagagattgaacgcctccaaaaaatcattgattacttccatagtggtgaatgccaatgtggaaaacgataaacctattgctagcggagaattgtcggctgttttgaagaagctcaatgattttactttagaaaaaaatggatttttaagtaatgctggtgaagagtttctatccaaattgaatgcagactcatcattgattaaaatgattaagcaagagctaagcattgatcaagaattggaggccaactggaaattgcagaggtcaaatttgttgaagaaaattagtgctttagaaaaccaatttaatgaaatgagccttaataatcggaatttgaaaacaaaattaatggttcaaccatataagaataacggtgattcgcttgctgccaccaattcgaataattccgcggaaaaaaacagaagttctggatcgattcaattaccattatccaacaacatgtcaagaacggggtccattgatttaatatcgaataataacaaaagtattaacaacagtaatgctgattctgctcctccgttgaggttgcacaatccagtttcgtactctccttcgaatgaacccatacaaccttcaagcagtctattgagtcaattgacacaggacaccgataatcgatcaatgctctccaatcacatctcatcgaacaacgaaaacaagcaacagccttcttcatattcacatgctttacctacaactgctactgctaatgcaacagcaacagcaacagcaactaatggtcactcaaggtcaaatttatggaccaccgcacaattcgctcaaccttcgcatcaacaagtatctacagaattggatcaagcttttgaatacgataatgcaaaccacttaatcagtggtttgcaaaatatgatctacgacgaaacagactatcctgataacataagcaattattccaagggttttactacagacgaacttgacaattactggactaagcagcaaccccaggtgcgcagcacaaatgaaagtcttttctctacgactggaacacctatgtcatcatataaggctaacccagtaatatctccatattctagttctcatttgcgacaaacctccaacgcaaccaatacgaatcctatgcatccacagagtctactcgccgctacattgaatgatccttcattacaaagttttgtacgcagtggttctttctacagtgctccgcaacctgcaaactccttacagaacaatatcaatggcaatgaaaccgagaacattagtccaaggatatcaagtgacttcaatttattggtgccaaacttgagcccacgactctcaaacgatgtgcccattgttccaggcaataacactactttaacaccttcacactcgaacatattaacaatgaaccatcaaccaacggcggataacattacacgaagatctttccatgcctcttcaccacctttcaactccatatggaattcaaatacaaatcaactttctcctccattggaggagcagtatcacctcgatgtgcctgtgggtccaaaggttcccgctaaagaaccaagccctaagccttctcacaagaggaaccaaagtaacagcagcatttcttctgcatggtccaagtttaagcacaagtctgcatcatcacctgctaatgcggacacggatattcaagattcatcaactccatcaactagtccaagcggtagaagaatgtcaaaactgttgtccaagagcggtatgaataatctatttaacccgcacagtcacgactcatgaacaatattataatacttccaggtcgtgtatatatgtagatatataaattatgaaacataatatatgaaagcagtttgagcttattcttaatcatcaatagggtaacggtattaatctcattttttctttttttttttctttttattttggcgtctcgtctcaatttcatttttcccatctttttacaacttcaatatgaaaaacataacacatgaaaaataactgtcaacattaataatattccttgcatagtgcttcgattttccaaatataaaaacagtttcttttacaagcttatttaattttggttttaaggagaaagcactaataaaaagggcaaggactgcaatcaacaatctttattggcgaacagttaagggtcctctcgagaagaaacattaagacatcatcgcacaaaaaacatggcgcccatctttagaaattaccggttcgctatcggtgcttttgccgttattatgctcattttgttgattaaaacatcttccatcggtccaccttctattgcacgtacagttactcctaatgctagtattcccaaaactccggaggacatctctatcttgcccgtcaatgatgaaccaggttaccttcaagattcgaagactgaacaaaactatcctgagcttgccgatgctgtgaagtcacaaacaagtcaaacatgcagcgaagaacataagtatgttatcatgatcgatgccggctctaccggttcccgagtacatatatacaagtttgacgtctgtacttccccacctacattacttgatgaaaaattcgacatgttagagcctggtttatcttctttcgataccgattccgttggtgccgctaactcccttgacccattactgaaagtagcaatgaactatgtccctattaaggcaagaagttgtactcccgttgcggtgaaagctactgcaggcctaagactcttgggtgatgccaaatcttcaaaaattttgagcgctgtaagggatcatttggagaaggactatcctttcccagttgtcgaaggtgatggtgtttccatcatgggcggtgatgaagaaggtgtcttcgcctggattactacaaactacctattaggtaatatcggtgctaatggccccaagttacctactgctgccgtttttgacttaggcggagggtctacacaaattgtttttgagcctactttcccaataaatgaaaaaatggtcgatggtgagcataaatttgatttgaagtttggtgatgaaaattacaccttgtaccaattttctcatctaggttacggtttgaaggaaggaagaaataaagttaactctgttcttgtggaaaatgcattaaaagacggcaaaatattgaagggtgataacactaagactcatcaattgtcatctccatgcctaccgcctaaagttaatgccacaaatgaaaaggttacattagaatccaaggaaacttataccattgactttatagggccggacgagccaagtggtgcacaatgtagatttctgactgatgaaattttgaataaagatgctcagtgccagtctccaccatgctctttcaatggggttcaccaaccttctttagttcgtacattcaaagaatcgaacgatatctatattttctcttatttctacgacagaacccgtccattgggtatgcccttgtcctttactttgaatgaattgaacgatttggcaagaatagtgtgtaaaggcgaagaaacttggaatagtgtcttcagtggcattgcggggtccctagatgaattggaaagtgactcgcacttctgtttggacttatcttttcaagtgtccttattacatacgggatatgacattccattacaaagagaattgagaactggaaagaaaattgccaataaagaaatcggttggtgtttaggtgcgtcattaccattgttgaaagctgataactggaaatgtaaaattcaatcagcttgaataagaacatggacaccgcttttcgtcccatgtatattaaggaagaggagattgcggtgatatgtattctgttatatgtcctattctataacccttgaacaatatgtaaacgatttttacgttatgaaaatcactattatccccacaatagtttattataacaccgccgccaagacaggggattgaaaaggccttccgaggtttatccatttttggtaaaagcccgccacgccttcaggtgtttgagtatgaactggaagagttatctgttaggacctcataatcttgaacatatgagataatttaatatacttttgttatggattgttccgttgttttaagactatatggctttgttttagttttagggtgattgtggatatcacaccggtcctcaagaaaatcgaaaacaaaaggataatcggacttatctggtgatcgaagaaactgcatttcaggtcgtttaataaactgctagctattgatattatatatataaataaacctacaatcaggttagtgtattcatctcacttctatagcgttgtgaaagggaaatggaaatagtgcaatctcaataaatctgcttacgtgacattttttactaaaagagaatatgaaaactgatagattactgattaacgcttccccggagacatgtaccaagggagatgctgagatggatactatggatactattgacagaatgacatcagttaaagttttagcggaaggcaaggtattaagcaacttcgaagaaccgggcttaatgaggtgcggttatcatgatgcaaaaaactgggtcagaagattatcgagcgaaacaattgtcggtgaggacacgagtaatttatacccattttatgttgatactgcatacgatgtaaggcgtttgagaaaggatcttataaatgctaaggttgacttgcaggttgaaaacctgataataatctgcaatattaatgatatttccactgtatttctcatgagagaagtggtggaatggatcttacgcaatttccattcaataactgtatatgtacaagatatttttaaaaagtcaactcagtttgctgttggtgacctctgcaaagacagcaattgcagtaaaaacagagtaaagtattggtcaaaagaatttgttaaaaaacacgattcattctttgacttgatgattacactagggggtgatggaactgtcctttttgcttcatctatattcacgaaagatgttccgccgattgttccatttgcccttggatcattaggatttctaacaaattttgaatttcaaaatttcaaagaaacgttgaaacatatcttaacagatgaggttcgtattaatttacgaatgaggttgcaatgcaaactctaccgtagaaataaaccagaaattgatgccgcaactgggagaaaaatatgttacatcgatttcatctccgaacatcacgtattgaacgaagtaaccatagatagaggtccagctccttgtttatccctattagaactctatggaaacgactcactaatgactaaggttcagggagatggattgattgttgccacgcctacgggatccacggcatactcattgagtgcaggaggctctttaatatcgccaagcgtaaatgccatagcggtgacgcctatatgtcctcatactttgagctttaggcctataattttaccagatagcatggaattaaaagttagagtagatatgaactcaagagggacgtcgtgggtgaattttgacggaaaagatagagttgaattgaaacagggtgactatgttgtgataactgcaagcccctattcggtaccgactatcgagtcatctgccagtgaattttttgaaagtatcagtaaaaatcttaattggaatgaccgcgaagagcagaagccatttgcacatattctctcgccaaaaaatcaagaaaaatatagattagactcatcgaaaaatggaaacgacaccataagtaatcccctcgagagttcatgcataagctcagatgcacaagatgaggagaggaaatccgtaacggaaacagaaacagaaatagttgttgaacggactcgtcaggctcattttgcaatctaacgatttcccacatcctgcgtttccgtagtcaagggttcataatggatgatgagcctgtaaacagctttgtatttacctcttttacttcaagaatgctcttgcgtcgtttgcagtgtcgaagaagatccagtagagctatacaaaatggagaaatgaaacagttgaaccagagcgccgcatttggcaggtagtttcgctaaatttcctcatgcgcgtttgtaattatgctagttaaccatatgataaggttgcctaacttgcagtcaccggaaggttatttccggaatggtgcagaataatttttaaaatagtagcatatatttcgttccaattcccaaatagggaattataattatgacagataaattcccgattaggaagaagcgcgaaaattcttgaaaaacttttttcaacctcgaagaaaatcgtcgtccttcgaagatttagtgggaatcttcaaggtggatagtttccaaattaaaactgcagaagaggcttttaaaacatgcctgaggtataaaaagaacaacattcctggtgattatggtttctgttggaccctgttccctttgtaaaacttctatttattgtcctgcaaataagctaattatataattaataatggcaatcgttaatagttggctaatttgtttagtcagtattttttccttcgtggtacgtgtagaggccgctacattttgcaatgcaactcaagcatgtcccgaagataaaccatgttgctcacaatatggtgaatgtggtactggtcaatattgtctgaacaactgtgatgtaagatattcgtttagtcatgattcatgtatgcctgtacctatctgcaagagttcatccactaaattcaaagattattcctctaagttggggaatgctaacactttcttaggaaatgttagtgaggctgattggttgtatactggtgacgttttggattatgatgatgaagaaagtttaattttggcgatgcccaagaacagtggtggtaccgttctttcctccacgagggctgtttggtatggtaaggtcagtgctagaataaagacgtcacatcttgctggtgtggtcactgggttcattctgtattccggcgcaggtgatgaacttgattacgaattcgtcggtgctgatctagaaactgctcaaaccaatttctattgggaaagtgttttgaactacacgaattctgccaatatttccactactgatacatttgaaaactaccatacttacgaattagattggcacgaagattatgtaacatggtccatcgatggtgtcgtcggtagaaccttgtacaagaacgaaacttataacgccaccacccaaaaatatcaatacccacaaaccccatccaaggtggatatttccatttggccaggtggtaattctaccaacgctccaggaaccattgcatggtctggtggtgaaattaattgggacgcatccgatatcagcaacccaggatattattatgctattgtcaatgaagttaatatcacatgttatgatccaccaagcgataccaagaagaatggtacttctgcttatgtgtatacttcgtccagtgaatttttggccaaagacattgctattaccgatgatgaggtcatgatggacagtgatgagggatctggcttggacccacataagggagctaccacatcttccacccaaaagagttcttcctcaactgcaacctcttcctccaaaacgtcatccgatcacagcagttcaactaagaagagtagtaagactagttccaccgcttcatcatcatcatcatcatcttcttcttcttcttcttcttcctctactgctactaagaacggagataaagtcgtatcctccgtatcctcttccgtcacttcccaaactcaaacaacatcttctgtaagcggaagcgcctccagcagtacaagctcaatgagcggtaataacgcaggtgccaacgtagcggcaaactggcgtttgactgttttatgtgtcatcctaggttatgtcttataggaggatctgcatctaagaacaaataggctacacaggactctcaaaaaaaaatgtattaataaataaaagaacttaaatatagactttttattcgcatgcatataaaaataattaattaataaataactgtaaaaaactagaataataaaagtaataaatatctcctccgacgacatagcctatttggcagcctttgtcatataagtaattaaatcgtttctgtccttttccttcttcaacccggcaaacgccatcttggtaccaggaatatatttctttgggttcgtcaagtactcggacatactatcctcatcccatttgacgttcttgttgatgtttgcatctgtgtaagaataaccctttacctgacctgaatgtctaccaaaaataccatgtaaattaggtccaactttgttaggaccaccctcttctattgtatgacactgctgacacctcgttttaaacaatgtagcacccttttttgcagagcctggtttgaatcccgtactttctttagccatgttttgtttatgatgtaatgtagtttactgaagtttacttaaagtaatgtgaataaatgcttgtatgtgatcttcttgtataagtctttgattttgtttcaacctcaacaaaaagagaactattctgatctaatcttctcgagcttcacaacacgatatatatatatgttgtgtgcctttgtctttgccccttgcggccacttatagtagttggaacttgaataaatgccctcgctattatcgctattagctttgagaaggtgggaaaagacccctcggcgggggactgcagacccttctcagagaaggcacgaaggaaaataattcaataaggggcgctataacccggctgctgatccatttcttttttcgtttctttttcttcaagcggaatgataataataataccaacgatgacggtggtgagtgggatgaatatggaatggtcattgggcaaaaggtcctgctagctcgtataccaaaaatgggagacaattactcgacttacttgcttgatattgaagggacagtgtgcccgatctcgttcgtgaaggagactttattcccttatttcacgaataaagtgccgcaattggttcaacaggatacaagggactccccggtttccaacattctgtcgcagtttcacatcgacaataaggagcagttgcaggcgcatattttggagttggtggccaaggatgtgaaggatccaatcttgaaacagttgcaaggctacgtctgggctcacggatacgaatctgggcagattaaggcgcccgtttatgcagatgctattgactttatcaagaggaagaagcgtgtgtttatctactctagtggatctgtaaaggcacagaaattgctgttcgggtatgttcaggatcccaacgcgcctgcgcatgattcgttggatttgaattcttatatagatggttatttcgacatcaacacttctggaaagaaaaccgaaacacagtcttacgccaacatcttgcgggatatcggtgcgaaggctagcgaggtactgttcttgagcgataatccattggaattggacgcagcggccggcgttggaatagctactgggttagcttcccgacctggtaatgcacctgtccccgatgggcaaaagtaccaggtatacaagaattttgaaactctttaacaaaactgtatatatgcgctaaaagcagtataatcattatttgttgttgttattattattattattgttattattattattattattattattgagattaatattaccatctctctgttttcttttctttcccttctagcatatataaatacacatacgttattgatttctacgtaagctttttttttcccttggctcaaaaatcatgcaacattgtcgagaataagtgaagatacttcaagccataacattactacaatctcagtcggcatgatcgctgaatagaatatttgctgcagcttcttcgtttttatcgcacgcaaaatacacctggataacaagatctctttcaaagcccaattcacagaggcgcgaaatagcttgatcgtcttcgggggtatagtcaacttggaaagaaccttcaccttcaccttgtcccagtcctgcagcagcagcctctcctgtaacttctatatcctctccttccaccatatcatccgcaccttccataacatcttgcatattgtcacccacggcttctagcaacatggacacaaacacttctgggtttgccatgatatgttcacgtaattgaggatatctagcacttatgttttccaacaatggggctaaagcttctgggttacctgaaacgacctgtctcaacgatagtaaatcttctacagtgaggccaatggaacctggaggtccaccttgcgcagcatctgtagctcctccagttgtgccaagcgcaccggatgaagcattaccgccttgggcagcttgtgcaaataagtcgtcttcagccggttgttccgcagtggtggcggctgtcgatggttgttccgctgcggcggctgtttgttgctgtggttccggttgacgcagattttctggaatacccatcagtagatattccaccgctctatctggattattaaaggctgctctcaaggctcgttcgacttcctctctttggtagcccatttccatgattctctcgatggtctcgttcctctcggttcccaccacgaatcccggtgtagaggcagattcagtacgttctgtagtggcggtttgttcttcttgcggttgtgagccttcgggagcagtggctgcaggagctgcagaagcatccgtactgggggatgcttctgtagaattttctcttccgggggtagtggcgctctcaggagcaattggaggttctgttactttggtcttcgtggactttttttgagaaaccatgaagacaacttggtccccatcttttagcccgcattccgatacggttttggaatcttgtagcactttacccgagtagatcagttttatttgagattcttcacaagaaatggattgagcaagcttggtcttggtctctaaaattgtgtttgaaggttccagatctaaaggaactttttccttcttgaaatttttaaaggttaagctaaccatttttctattgtatgttgtctttgtgtgatctgtgatttaaaggtggagttagatgcctttattaagtctttagaggaaggaaaattggatggtagcaagcttgtctgcgaacggccttatcaatggttcaaacttaaaaacagggagaaaaacctaagtgtaccttctagctttagctactagtcaatactggatgggaccttgttctatcattttttcttaagttttgctgtcgctatttcttgcctagccataatgaaagagaagaaaataaaaaaatttcaatttcgccaccgagccgtgtatagtgattgatataacaatggtattgtaattcactcaaagaaaagttaaagaccaaagaatagaggtttgatattattatcggtatatatgtacaactatatgaattcgtacttcatatgtaggtcactaaaaaaccgagcctagtttctatcagggtcgaagtctaatggaacttctttaggatgttttttcttgttcttgtcgttgtcatcaagaggtttcccctgcgggttgccgtcgagctgttgttgctgttgctgttgctgctgctgctgttgttgttgttgttgctgttgttgttgttgttggttgtttggtgagacaaagtcaccctttgagtccaccagctccgagccatctccctcttcagaccagtctacagtgactttattgttcaaagtggagtcaatgttttttaagattgaatctctttcttcgttccattggtctctgacatcttcaaatccaatctcccagatcttgttgtaaaattcgcgaattctctcttcttctagtttccgcttctcctcttcagccatccaagccatgtgctttaagtcgtcgctggaaggttcgtagatgtgccagatgacataatggggcaagccgatgacattgtaattcatcctgcgggagagcctaccgaatgcttctgtctctgcgtgcttttcaaaggagaatgcaggaaagtgtgagcctgttctgaatactttagctttcgcgagaatcgagacccctccaataccgtccaattccatttcgtcttctggattaccgtttgggtctctcatgtatgccaggtgaggtctccaagtggcgtactctgggtacccttccacaatgacagcatcttcgtctagggaatccgccaattgaagacccccttctgattccttccatgaatttaaatcgtagggttgaatgtttcccagccagtctggtaaaggtctccagacgttggggacaatgacgtccttgtcgtgatgcattagatcctccatgatggtagtggggatggtttcgacatccacgtctctccagtaaacccaggagtggtatggtttcagggccacggacccaagccaattacgagccctggccatcagctttcttctggggccctgggcgccaaacccgtgacgatcagaaaaggactgaccaatgatttggccgaagtccttctcatagatttcgatgttaccaaaccttttggacttgtcttgttgcgattgcgccatctgtagattggatagtaacacgcccatggtgttatccgaagagtcactcaccaaaaacgacagatcaatcaggttgtgcggatatgtcatggtattcagatggttaaaaaacatgggaagatgctcagaagcatctctcagtggcacgcaaaacaagatgcggtcaccctgttgccaaccatctttgttgccttggtaatttcgtaggtcgtagaactctacgctgggagtatttttaaaatctggaacatagggcttgaagattccttggaaagttaccagctggaatagcgatatcgagaagaacgaaagcacgagtcttgtgagaaagaacaccgtaagcaacgttccagcgatacttactgtggtagggttgaacgagagttttctgttattatacttcattatggacgtacactttgcatgaaagccacaaggaactgtttaatggagcgaaaaaaagatgatgagggtaaatcgcaccaacactcgcctagcaactgagtgatgaatggttttgcaatgcttgctgtctctactaacagatcttggcgtttttgaatcgtgtagttatttttatttattttttttatttcatgttttcatgatttcatcttacgcaattttttcacgatgagacaaggcgggcgaccccacacaagaggaaaattgaacacaatgcgttggtaaagggattacgaattgattaaaccaacatagtgagacaagaaaagaaaagaaaagaaaaggaaaatgaaaaaaaataaaaaaaagaaggcaactagaccagatgagcccggttcatttctattctctgcagtcactgctattttcatcaacagcgcaggccaagttgaacgagatagtagcaatcgtaaaaggaactagctaacttcatcatgaaagtttaccctttcttgccgctacccttctcgtttggctggtattagagcacagcggatatatccggctcaacagtataagtaacgataagtcctgaccattggcttcgttctggtggcattttctctgaggggtgagaacagcaaaacgggaacggcgacttggagtagtataacgctgtagctggacgctgaggggccaaggccggtaaaattctgcaacacccagaccttgctgcagtgatatcatccacccatacccctcgatgtattccgtagcgttatatcgggtccgtgtgaggcgacaagggacctcccgcaccgcacataccgcaggagctaaaagaaacgccgtcgcccgaaaaaaagtttcgaaggtgaaggaacagtggtaataaaaatttttttcgtcgtcgtcgtcgatcggcttttggccgcgttgatcgtcgtgttccacgattatataatgcacaaggtttttgccatatcttgacattggaatccctcatttcctaaattcctctccttctatcaattgcttcctttccttctttctaacgattctacttctgtagccaattactcatagactcccaaacacacacaaataccaactcatatatacaatgtctgacgaagaacatacctttgaaactgctgacgctggttcctccgccacctacccaatgcaatgttctgccttgagaaagaacggtttcgttgtcatcaagagtagaccatgtaagattgtcgacatgtccacttctaagactggtaagcacggtcacgctaaagtccatttggttgccattgatatcttcactggtaagaagttggaagatttgtctccatctactcacaacatggaagttccagttgtcaagagaaacgaataccaattgttggacattgatgacggtttcttgtctttgatgaacatggacggtgacactaaggatgatgtcaaggctccagaaggtgaattgggtgacagtttgcaaactgcttttgatgaaggtaaggacttgatggttaccatcatctccgctatgggtgaagaagccgccatctccttcaaggaagctgctagaaccgattaaaccggttaacatcatggcatgggatataaatgaaaaaagaaaaaaaaactccgacgccccttccatcacatcatgtactcttcgctgaaccgggtttttttctttgcaatttttttttcgttctcctaaagcatacacaaataaatccttttttttattttctatttattttgttatttatcatctatatagcaataatatactttgtttttattcgtatttcacacttttctttttccttatgcaggcagtgtaattcattggggaggatgattttcatgtgcgcatatctaccggctgcaagcagccggtcggtggcaaatccggcgcttccccctcaaaaaaaaaaaaaaaaaaaaaaaaagggaactctcagaacgggggaggttgaagagcaggccaagggaaatattagttttgacctatgtgggaaacagaattttcaatgagttatggcaacttggccgagtggttaaggcgaaagattagaaatcttttgggctttgcccgcgcaggttcgagtcctgcagttgtcgttatttttctcttttttttcaatttcccttgttcgtcagatcgaggcggtagaagaaacaattacttttcctaaatgggtaaaaactcgtgttttaggaaaaaaaagaaaaatttggtcaaaactcgaaagataggttcttaatcttctttcaagttgaaaaggcctacgctcttttccttgaagcattttcatcctactgctcgtattgaactccactataagcgcaccaaaaagatacaaacgtcaattatggaaggctcaacgggatttgatggagacgctactacttttttcgctccagacgctgtgtttggtgacagagtgcgcagatttcaagagtttttagatactttcacctcatacagagactctgtaaggtccatacaagtttacaacagcaataacgcggccaactacaacgatgatcaagatgacgcagacgaacgagatttgctaggtgatgacgacggtgatgatcttgaaaaggaaaagaaagcagcatcgtccacctcattgaatatactccctcacaggattatcatctcgcttgatgacttgagagaattcgacaggtcgttctggtcgggcattttagtcgaaccagcatacttcatcccgcctgccgaaaaggcgcttactgacctagcagattccatggacgatgttccacatcccaatgcctctgcagtatcgtctcgccatccttggaagctttcgttcaaaggctcatttggtgcacacgcattgtctcctcgtactctaacggcacaacatttaaacaaactggtctctgttgagggtatcgtaactaagacttcgttggtcaggccaaagcttatcagatctgtccactacgcggcaaagactggtagattccattacagagattatacagatgctactacaactctcaccacccgcatcccaacgcctgccatctatccaacggaggacactgaaggtaacaaactaaccaccgaatatgggtatagtacgttcatagaccatcagcgtatcactgtgcaagaaatgcccgaaatggcccccgctggccaacttcccaggtccattgacgtcattctcgatgacgaccttgtggacaagaccaagccaggtgacagagttaacgttgtcggggtattcaagtcgcttggtgctggtggcatgaaccagtccaactctaatacattgatcgggttcaaaactctgatcctaggtaatacggtgtatcctctccacgccagatccacgggtgtcgctgcgagacaaatgttgacagatttcgatataagaaatatcaataaactatccaaaaaaaaggacattttcgatatcttgtctcaatctttagcgccttctatttatggacatgaccatataaagaaagccattttattgatgctcatgggaggtgtggagaaaaatttagaaaatggctcgcatttaagaggtgacatcaatatcctaatggtgggtgatccatccactgccaagtcccaattgctaaggtttgtgttgaatacagcatcactggcaattgctactactggtagaggttcttccggtgtcggtttgaccgcagcggtcactactgatagggaaacaggtgaaagaagactagaggctggtgccatggttcttgctgaccgcggggttgtatgtattgatgaatttgataagatgacagatgtggatagagtcgccattcatgaagtaatggaacaacaaacggtgacgattgccaaagcaggtattcacacaacattaaatgctcgttgtagtgttattgctgccgcaaatcccgtttttgggcagtacgatgtcaatagagatccacaccaaaacattgccctaccggactcgctgttgtctcgttttgatttactatttgttgtgacagacgatatcaatgaaatcagagatagatccattagtgagcatgtcttaagaacacacagatatttgcctccaggttatttagagggtgaacctgtgagagagcgtttgaatttatcattagccgttggggaggatgcagatataaatcctgaagagcattccaactccggggctggtgtagaaaatgaaggagaagatgatgaagaccatgtcttcgaaaagttcaaccccttattacaagcaggtgctaagttagcaaaaaacaaaggtaactataacggtacagaaattccaaagctagtcaccatcccattcttaagaaagtacgttcaatatgccaaggaaagggttattccacagttaacacaagaagccatcaatgttattgtgaaaaattatactgatttaagaaacgatgataataccaaaaaatcgcccattactgcaagaactttggagactttgatcagattagccacagctcacgccaaagtcaggttatccaaaacagtcaacaaggtggatgctaaagtggctgccaatctactaaggtttgcactattgggtgaggatatcggcaatgatatcgatgaagaggaaagtgaatacgaagaagctttgtcgaagaggtctccacagaaatcaccgaaaaaaagacaaagagtcagacaaccagcaagcaactctggatccccaatcaaatctactccaagaaggtcaacggcatcttccgttaatgccacgccatcgtcagcacgcagaatattacgttttcaagatgacgaacagaacgctggtgaagacgataacgatataatgtcaccgcttcctgcggatgaggaagctgaattacaaagaaggcttcaactggggttgagagtgtctccaagacgtagagaacatcttcacgcacctgaggaaggttcgtcgggacctcttaccgaggtcggtactccaagattacctaacgtatcttctgcaggtcaggatgatgagcaacaacagtcagttatttcttttgacaatgtggagcctggtaccatttctactggtagattgtctttaatctcaggtattattgcgcgtctgatgcaaacagaaatatttgaagaagaatcctatcctgtggcctctttgttcgaaagaatcaacgaagaactaccggaggaggaaaaattctccgctcaagaatatttagcaggtttgaagatcatgtcggacagaaataacttaatggttgctgacgataaagtttggagagtctgatgtcacaggaatgtttactaaaagacttccattcttggctttttttctttttgtcattcataattttcagttcatttccagattatttagttcattaattgttattcgtgtattaaagaattatgtattaaaacgcttatttccttcttttgtttgaatgtgttgtaagcagttatggggcactatatcttctgttaatgaatatgtgtgatactttggcttatcttacttgctcattcgtggcttcttgtcacgccatacgttacgcgtttctcttcctcttcgcgtgttctgaataaagccaagtggcaatgtctcttccaccatataacatgaagctttagcaagcttttagctctagacatagttgacatatcagacctacagaaacataggaatcggtaaatgacaaagaaatcatttgtgagcagtcctattgttagggactcgacattgctggtaccaaagtcattaatagcaaagccgtacgtattaccgtttttcccgttatacgctacctttgcccaactatatttccagcaatatgatcgttacatcaaaggacctgagtggacttttgtctacttggggacattggtatccttgaacatcctagtcatgttaatgcctgcttggaatgtcaagatcaaggcgaaattcaactacagtactactaaaaatgtcaatgaagctactcacattctcatctacaccactccaaataatggttctgatggtatcgttgaaattcagagagtaactgaagcgggctctttgcagacttttttccaatttcaaaagaaaagattcttgtggcatgaaaatgagcaggtattttcttcaccaaagttccttgttgatgaatccccaaagatcggtgatttccaaaaatgtaagggccattccggtgacctaactcatttgaagagactatatggtgagaatagttttgatattcctattccaacatttatggaattattcaaagagcacgctgttgcgccattgtttgttttccaagttttctgtgttgccttatggctattggatgagttctggtattattctttgtttaacttattcatgattatctccatggaggcagctgcagtatttcaaagattaactgccttgaaggaatttagaactatgggtatcaaaccttataccattaacgtgtttagaaacaaaaaatgggtagcattgcaaaccaatgaattgttacctatggatttagtgtctataacaagaaccgccgaggagagcgcaattccttgcgatttgatcttgctcgatggctccgctattgttaatgaagcaatgctttcaggtgaatctactcccttgttaaaggaatccattaaattacgtcctagtgaagataatttacaactggacggtgttgacaagattgctgtgttacatggtggtacaaaggcattacaagtaacacctcctgaacataaatcggatatccctcctccacctgatggaggtgccttagccatcgtcaccaaaactggctttgaaacatctcagggttctttagttcgagttatgatttactccgctgaacgtgtttccgtcgataataaggaagcgttgatgttcattcttttcttgttgattttcgctgttattgcatcctggtacgtttgggttgagggtacaaaaatgggtagaattcaatccaaattgatcttggactgtatattaattattacatctgttgttcctcctgagttaccaatggaattgaccatggctgtcaacagttctctggccgcccttgccaagttctatgtctattgtactgaaccatttagaattccatttgctggtagaattgatgtttgttgtttcgataaaactggtactttgaccggcgaagatcttgtgtttgaaggtctagctggtatctctgcggactccgaaaacattcgtcacttgtacagcgctgccgaagcaccagaaagtacaattcttgtcattggtgctgctcacgctttagttaaattggaagatggtgatattgttggtgacccaatggaaaaggcgaccttaaaggctgttggttgggctgtcgaaagaaaaaacagtaactatagagagggcaccggaaaattggatattatccgtagatttcaattttcttctgctttaaaaaggtctgcttctattgcttctcacaacgatgccttgtttgctgctgtcaaaggtgcacctgaaacgattcgtgaaaggctttctgacattcccaagaattatgacgaaatctataaatcctttacacgctctggttcaagagttttggctttggcttctaagtcgttgccaaaaatgtctcagtctaaaattgatgatctaaaccgtgatgatgttgaatctgaattaacctttaatgggtttttgattttccattgtcctctgaaggatgacgctattgaaaccattaaaatgttaaatgaatcctcccatcgttctattatgattactggtgataatccattaactgctgttcatgtggctaaagaagttggcatagtttttggcgaaactttaatcttagacagagcaggtaaatctgacgacaatcagttgctgttccgtgatgttgaagagacagtttccatcccatttgatccatcaaaagacacttttgatcattctaaattatttgatagatatgatattgctgttactggatatgctttgaatgccttggaagggcattctcaattaagggatctattacgtcacacctgggtttacgcacgtgtttcaccatcccaaaaggagttcttgctgaatacactaaaggatatgggatatcaaactttaatgtgcggtgatggtactaatgatgttggtgctttgaaacaagctcatgttggtattgcattgttgaatggtaccgaagaaggtttgaaaaaattgggtgaacaacgcagattggaaggtatgaaaatgatgtatataaagcaaactgaatttatggctagatggaatcaaccacagccacctgttcctgaaccgattgcacacttattcccacctggtccaaaaaatcctcattatctgaaagctttagaaagcaaaggtaccgtcattacgccagaaatcagaaaagcagttgaagaagcaaattccaaacctgttgaagtcatcaaaccaaatggactatcggaaaaaaaacctgctgacttagcttctttgttgttgaactctgctggtgatgcccaaggtgatgaagcaccagctctaaagttaggagatgcatcttgcgctgccccttttacctcgaaactggccaatgtttctgctgttactaacattatacgtcaaggccgttgtgctttagttaacacaattcaaatgtacaaaatcttggccttgaattgtttaatcagtgcctactctttgtccatcatttacatggctggtgtcaaatttggtgatggtcaagccactgtctccggtttgttactatcggtttgtttcttgagtatttcccgtggtaaacctttagaaaaactatccaagcaaaggccacagtccggaattttcaatgtttacattatgggatctattttgtctcaatttgccgttcatattgccactttagtttacatcactacagagatttataaattggaacccagagagccacaagttgatcttgaaaaggaatttgctccatcattattgaatacgggtattttcatcattcagttggtacaacaagtctctacatttgctgtcaattatcaaggtgagccattcagagaaaacattaggagtaacaaaggtatgtattatggtttattgggtgtgacaggtttggcacttgcaagtgctactgaatttttacctgagctaaacgaagccatgaagtttgtgccaatgactgatgactttaagattaagttgaccctaacattattgctcgatttctttggtagttggggtgtcgagcattttttcaagtttttcttcatggacgacaaaccatcagacatttctgtgcaacaggtcaagattgcctctaaatgataaatcttttatgtagtacccctttttgtatttatatacttatattacccattcatatagatcttttttaatgggtgtattgttaagtttatgaaagtgctgtattatttgtaaaacagcttctaagtatacgaaaattataatagcttcaagtttatattttgttgctagcgttacggttatgtttttacgatacatatcgcctaagcaggtctctgcgcctaaaaaaagtaaacatataaattgggaaagcaatataattaaacatactgctatagtaaattcattactaggccaatttaaccgtgccttattatgatatgaaataccagtcaacaagtcccgcttaaatgcactctagtaaagctacaggtggttaacaaaaattaagaaaacagaacaaccacgagattctttgaacacggtctgtcaaagatcttgacttggactagttacacaatttattttccaactgagtggtttagcacaggaatagtttaatcgggtcttaaatttttactttgatttttgcaggggagatgctaagtcaaattgcagcaccctttaaagggtcagacgtagaacatcaaaaaaagaacaaatctcaaaaatgattatttaactaagattagcaaacttcaaaatcatggcgattaattgataccctattgatttttttaccgaagagcatttgtaactatttcactggtcataattaagaacttaaattcaagtaacatgttaccatcatggaaagcctttaaagcacataatatacttcgtattctgacccgtttccagtcaaccaaaattccagatgcagttatcggtattgatttaggtactaccaattctgcggtagctattatggaaggtaaagttccgagaattatcgaaaatgcagaaggctcaagaactactccgtctgtagtggctttcactaaagacggagaacgtttagttggtgagccagccaaacgacaatccgtcataaactcagaaaacactttgtttgctactaagcgtttaatcggccgccgtttcgaggacgctgaagtccaaagagatattaatcaggttcctttcaaaatcgtcaagcattctaatggagatgcctgggtagaggctagaaacagaacgtactcccccgcccaaataggaggttttatcttaaataaaatgaaggaaacagcggaggcttacttagcgaagagcgtcaaaaatgctgttgtcaccgttcctgcttacttcaatgatgcccaaagacaagctactaaagacgcaggacaaattattgggcttaatgtattacgtgttgtcaacgaaccaacagctgctgccctagcttacggtctagataaatcagagccaaaagtcattgctgttttcgacttgggcggtggtactttcgatatttcaatcctggacatcgataacggtatctttgaggttaaatctaccaatggtgacacccatttgggtggcgaagattttgacatttatttgttgcaagaaattatttctcatttcaagaaagaaaccggtatcgatttgagtaatgaccgtatggctgtccaaagaataagagaagccgctgaaaaggctaaaatcgaactgtcttctacactctctacagaaataaacttgcctttcataactgctgatgctgcaggcccaaagcatattcgtatgcccttttctagggttcagcttgagaatataaccgccccattgattgatagaacggttgatcctgtcaaaaaagcactgaaagacgcaagaattaccgcctcagatatatcggatgttttattagttggtggtatgtcaaggatgcccaaggttgcagatactgtaaagaaattattcggtaaggatgcatcaaaagctgttaaccctgatgaagcagtcgctttaggggccgctatacaggctgcggtcttgtctggtgaagttaccgatgttttgttgctagatgtcactcccctatcattgggtattgaaactttaggaggagtttttacaaaattaatcccaagaaattctacaattcccaataagaaatctcaaattttttcaactgcggcatcaggtcaaacatcggtggaagttaaagttttccaaggtgagagggagttagtcaaggataacaaattaataggtaattttactcttgcgggcattcctccagctccaaaaggtaccccacaaattgaagtcacttttgatatcgatgcgaacggcatcatcaacgtttcagcaaaagatctcgccagccacaaagactcttccatcactgttgccggagcgtctgggctatctgatacggagattgatcgaatggttaatgaagcggaaagatataaaaatcaggatagagccagaaggaatgccatcgaaaccgctaacaaagctgaccagctagctaatgacacagaaaattccattaaggaattcgaaggtaagctagataaaactgattctcaaagactaaaagatcaaatttcatccttaagggaattggtttctcggagtcaagctggagatgaggttaatgatgacgatgttggaacaaaaattgacaatttgcgaacttcatcgatgaaactttttgaacagttatacaagaacagtgacaatcctgaaactaagaacgggagagaaaataaataacacaagataataaaaaagataatattttcgtttaaaatttcagaaatattgcttacatcaaacgaaatagtaagcgtaaaccatatatcctttcaacgatatgtatcatttttatagtcttttggcggtataaaaagaatagccaaaggtggaagtcaggttaaaccaaaagaaactacccgcaagggatgtatgcatttgaacataaaaaactattcactattttacaaatgtcaacattaattttctttggtgaaaatatgactctataaagtttcatcacaaccttgcgtaaatataatctgtttgatgaatgttgattgtttcatatatatctcttgattcaataagacgcaattccatttctttcatttccaaggcggaacccatttttgctttcatttttcctgaagcatagctcctagtaattttcaaaaccttctgaataacattaagaacattattgacttggtcttcaaattttaatgttgttgtagggttcgataagatcttatacactcgatccaataacaaagcagaaaacaaatcaccaaccccagtgaaatacgaatcaataaacggcactctgtaaacaatgggggttttaccctccattgaagctacgcaataaataaaatctttgtcatcaaacatcttacagtcacaggatgtgacaatgatcactgggatagtttggtgtaatttctttaaggccttcttcaaatgttctttagtcttgatttcccccccataaagtatctccagctcaaattgattcggagttattatatcgactagctgttttggagacaaagccagctttctatattctggtatgacatcctcactaacatataattgtccttcgtcacccataacaggatccataagccatatcatttctggattcgcctctttaaatttagcgtagtatgttcccatacatcgaacggaattcttattgggcaagtagcctgaaagtaaggcttggtagtcttgggaaaaattatcaaaaagacctgataagagttccttcaaatctgtttccctcgttatagtcccaaacactttatctaaaccatatccggtatggttggaaaactgaacactgttacaacaatccacatcccagcctagacactgtaagggaaacgttgcagccttatttcccacatatccatgtacaacatgagactgcgtggccaagagacgaggcattttttcgtaatttttcgatagctactgcagaccaaactcagggagatttagtagtcagtgaactcaaattcttttcaacttttaaatctacgcaaactaataaattttcggtcgatagtaaagcagtcatgattacatctcttgcttatttttgaaatatttcagtcatcggacaatggcggaaatagaattcacatatttccgcctttgatgcaagaaaaggctaaaaggctcatgaacttaactgttacaatgttaaattagctaaaaggcagccatcgccatgtcggaggaaaaaaaccgtaacaataaattaggtttggacttttgcagtatttaatgagagttggtggccaagaataatggatgatagcgcatcaaaaaaaggaagctgatatgaacgacttcacatagaactttgactcttctacaacgtgaatgcctttgataagaatgaaattccaaaacaagtagtgttgggaggtaaatttcctccactgctaattccaactacgtgtgcatttttcaatagtaatattccgtcacaagaggcttattttcattttctctaccctcatctttttttcacttttttccttacaatgaatacatgtgatatagatacttaattgtctgttttgcgagcttgcttcttcatatctatgtaatatgggccaggtcaacccaacatctaccaattatctatatgatgaaaaatatgattggtagttaccgccaatgcatagattttagacaacttaataaggccatgttaaagggtgcattcccactatcgcgcttaggattggatgaagcataacttttcttcactgtcaaattgcatcgtagttatatcagatccaaataaaaaatgaaaataacaataacaagccttctattttttcttgtcatgatcgtcgagctcgcaagtgcgggcacactacttcataatggtgcaaatttgccctcattacgtgataacaccactctaactgatgctcgtaatgtgttaaagtacttacaagtgcttggttttccaagcaacaaaatagcggctacagatactgttggaacttttatcatatttagcaatcgtacggaagctaacactaccgctatgacgaagacagtgtcatactgttatcgtaactacgggcatagtttctacttcactcattacaaatacgactattttcctagcgggattagttatatggcaaaacttggcgatgccaccgtcaaccatacggacttacctcactttaggaacaacaaacggctaacaacgcaagaactcaatgccttccaacatccaattgtcgagtttcagtaagtactcaggtattacgttatgtacatgtatgataattctgattaacatcttttatacacaaagatgtatgcatgaatggtgcaaatatctcgacgatgcgcagtaaagaaagcaatttactactaacgtctagcgatatcatagatgatgacaggataacgatataggttagatggatattggagtaattgtcaagtcccattttgattgaagacaacattattaggcctacagagttgctaaaattctccactaggtcacaggagttcgcaaaagagaatcaacaatctacataaccatgcacacatttcttcgtcctctacgttataatttactgctctaaaagcgtcacttctcctttcattttatgttttattgttcattatcctactgcgttatcaatccttacatttcggcttccactaaatttaatgactgcttctcatcatttcatgtcttctaacgccgtatataataatatcccagcaaaatataactgttagttagtgaatcataaccgactgttactcctgcaatatccatgggagaaatcaccatcggaaggtaaactaacacgtaggtattgattctaccggaaatgaacaaatgtcgtactgcccaaatgagccaaatgccatcatatacgccttcataactatatttgaaaaatacctttgcctaaaagacgagtggtattggaaacttcaattagtgttcaaaaatgtccagtgagaggatgaagttgtcgtggttgaaacagcataaaccacctaaaatagtatcaactgacaacaactgtggaacacatgcggttacttttataattaaccgcaaaatacctgaaatgagctaagaaatagtaattataaacatgccactacaagtaacagattaagtgatatgttggcggacctcaatataagcgacatggagagatagagatagaagaatttgttattgtgttaataaataaagttaacatccagttctttcaagttggctaagcgccgtggcgcagtggaagcgcgcagggctcataaccctgatgtcctcggatcgaaaccgagcggcgctaatttttcatttctttttgcccgcaacaataacacagatcgcaatcatttaagctatagactataagctttaacttctgcgttattattaataattgttattgttttagttaggtatttctatcaacttattttatatattctatattacagttttctttttttacaaattcacccagcaattatttattattaattgtacatcttctttaataatgaatttattattgcacaatattcaacttaggaaagatagaggaactgaattctttatcagcaatgaaataggccgtctacggccgtctacggcctattccattgctaaaaatttgaatcgtataaagggatattacccggaaaagaaacgcattaaaaaaaaaaaaaaaaaaaaaacagaaaaagtggttaagtgattgactgacccttgatagttttgtacaattatacactcgttctgattaaaaacttgtttataaaaatctttttaaaagaaagagaagatcgtgtttattgcttttctcaaaaagactaatcaattagaataacaaaagaaacatatacatataatgactgaattgtgtcctgtctacgcccctttctttggtgccattggttgtgcctctgcaattatcttcacctcattaggtgctgcttacggtactgctaagtctggtgttggtatctgtgccacttgtgtgttgagaccagacctattattcaagaacattgttcctgttattatggctggtatcattgccatttacggtttagttgtttccgttttggtttgttattcgttgggtcaaaagcaagctttgtacaccggtttcatccaattgggtgccggtctatcagtcggtttgagtggtctagctgctggtttcgctattggtattgtcggtgatgcaggtgttagaggttcctctcaacaaccaagattattcgtcggtatgattttgattttgatttttgctgaagttttgggtctatacggtttgattgttgctttgttgttgaactccagggctactcaagatgttgtctgttaaggcagcttctgaatcactaaagcaggaatagagtatacaaaagaatctttttgtgagaaactatgaaaactatcaaaatttttcatcttagagattgtttatagcccctattcttacttcatatccaaactacctcatttcaagcttcctttttattagtaccattattattgtttaaaagagtattacacgctaaatatgtatatcttaatttttaatgtgtataaaatagaaaatttgaatatcaaggagcaacaaagagcattatgcgttttaagctacacaatgggtacgatgagatcactatacctgtactcttaaaagaggcccaaccttatcaacttctattgttaaagtagacaattgtatcgtttctttttcttatcggttttatccgggtaataaattcagcatatagaaaaatttttcatttctattttctttttcttttcatttttcctttttctcagaaaatttttttttctaatgctggaatgagatgagttagaaaatttttcactttaaaactgattattctggttaatagtgcttattcctcttagtgttcaagtcctactttcaaatcttaatttaaatcatcattcgagcgagctttctataccaggaccatactgattattgcaaggaacttgaataaaccagatttcatactataaaaactatattaaaaatgtctgccccaaacccaaaggctttcccattagccgatgctgcattaacccaacaaatcttggatgtcgttcaacaggctgctaacttgagacaattgaagaaaggtgccaacgaagctaccaaaactttgaaccgtggtatctccgaattcatcattatggctgctgactgtgaacctattgaaatcctattgcatttaccattactatgtgaagacaagaatgttccatatgtctttgttccatctagagttgctttaggtagagcttgtggtgtttctagaccagttattgctgcttctattaccaccaacgatgcttctgctatcaagacccaaatctacgctgtcaaggacaagattgaaactttattaatttaagtagattggattatatctatcaacatagtttttgtaccatctatatactataaaaaagttttttgctttccactagtgcagacgctaatagtgctgttttgttagtggtatgatatatgtcatatcttcattgaataacctactcgagtgcatctgtaaatgcacaaacatgtattatcaattgagctgtagtaatttaggcataacaaaaaggtgcaagatctcatggcacctattcgttcgtaggagatttattgtcacctttttagttttacaggatcgaaaaaatctatggtcttgtatggtgaatgatctatatgtcttctctttgaatttctagctagctcatcaaagccgctttcatttattccagtctctttactcacggaatattgtttagtaacatttcgcatgcttttctcagaccttcgaaaagctcttttacattcgagcttgatctttttgtaatcatgcaacgttctcatccacagctcaccaatgaattccgatattatataaatttggccctcagtaccgcaaagtaaaaatagaggtatgacgccttccaacctttgactattgaaatttggacatatttgaaggttttgaaatccatctgggatggccgccagtgagattatcttattaggtaaccgaattttgaggtatggcatagccaacccgcccttatcaactgataatttagaatcttcgtatattgtcaaggtattatcaataccaatggtggcaacataagatctattggaatatttcaacgttgcacaagaaaggtctgataatcgacctaatagatagttcttatcactcgctaaacaatcgtttttaggttctcttagcttcttaggaattattttagtcgccacttgtgtaatgcttcccaaccgcttaaaacccaagtagggacattcagggtactctgatggatatactatggacgtcctaattggaaagcgggttctcaaaaaatctctcaagatctcaaattgaaccagataatcaccactcatataagctggaagacctatatggttaatcgatgaaagtgctgggaaggaataggcctctaaaatttccgcgccctcttttagcatgtttattttatatgctgctatgccactatcaccagaaaataaaaccaagttgcactcatagtatatgaacaccgagaatatacaatcttcgagataattcgcgtacaattgggtaatgttattgtttctaatttcaaacagccagaattttgtacgtttttcaccaactcctaagcatacaacaaacttattaccataaaagggtctctgtgataagtagattgagttttgttctggccacagtggcttcacaacggcatgtaaatacttttcatccgagaaactgaatgtggaaactgccttcattgaagcataattgaatagcatcaacttatactgcctactattgctatcgaccaaacacaccacggcctgattgaggttatttggaacagtatagagctctacgggaatgctagggaggtaaaagatatgattttctaattgaggttttaatgaagtcatctgcttagtgaaaccttcacggtaaaacgtgctaccaaactcaaagatgcttattcgagaatcataatctaaaacacaaagagagaacagtgctttaccgggtcgaattctcattcgtcttggaactaagcctaactgtatgcaaccataagacatgttttgaagatttaacaaaattatttccttatcgttgtaaaggaaaaccaaaggtaaggaaggaatcgtatccaacagttctaatttctgatcgtataacgaatgaatctctaaatccactctcaaaaaatttgattctgatttgtagactcttacgcagccagtgtatgatgatgcgatgacataaatcgagtcgtgtttatgctttttgcttagccaagatatttttatcaattgatcataggctatgaaagaatagtctggatgtgatgtagccactttcttttgattggcattccataccgaaaacacaccgtccaagtaaatgacaaaaaggtatttctcggcaccatctgagaaacagctcacaatactctctttagaattgagcccatggataaaaaattcttcttttttacgtagaaaaccagattttgcctcaagtatcgaaatcctgagcttggagttctgtacgggataacaaaacatggtggaagagttgtggttcgactgcaagaaatcgacctgcctaaattctccggtagaaccatccataccggctttcaaaacttttcccgtcctagaaacaaatagaccgtaatcataaggctcatccattaaaaatattccgttcttataaatcaacccacctgattcatatgcaaattcgtcaccaccattaagtgctaaatctgtaacccaaaaatcagttacattctctactagcgctttggaggaagtcactaacttgaacagggttttgtcatataccaaaattttcttttctaaaaatcctcttcttgagttaaaacttccacccaaaagcagtgaatcaatatctgtccccttgtttccaataacttgtgatgccaggtaaactttgtttgtataagcgggaccgcttttcaccttttctaattttgaacctcgatgatctttcgatataaaatttactccatttattcttgtcaccgctatatacttttcacgtgggagctgcaaaataacatcgcatagatcatgtttaggaggcttgaacactctttcttttgtccattgtagttctttcaggacgtggtctctatgtaacgacctagtgtgtatcttggcagtgtatttgttagcatacacgtcagaaattgtcaagagaatgactgatctttcatatatcacatcataagaatcttttagaaattggtagttttctacatttgggagacctttattattgaaaaaagccccgtttgtaagcccacttgcttttatatttattatttgagtgtagttagtagtcaacactacaatggtatggccgcaaactaccttcatataacaaaattcattatcacatatcggcaaaagattgtattggcggtactcgtttaaatcaaatttcctacttccatgctttccagcaagattgtattcctttaaaaacaggttttcactatagcaactcttaagtaggcaaagaaaataaacgtgtgatttacctgtgcatgtggcgtcgtcaagcaaatcctccctgctaataaaatcaaaggagataatttcttcgccatcggtggcataaaatctttcgactattccttctctgaagtcaaaggagtaaattgtcgtacataacgtatgcaaatcactatcatatgatatgtttttattgcaagtgtataaaacaccctcaaaggaagcatttaaccagctggaagttaataaagaaatagtatccagtttcggagccacattagagtcgtagataatttcaaatttgttattttcgcatttgaatcccttaatggaaccgtcgttaaacattagcaggtgacagaaggaagctgacatgaacatcggtacagttgcgtagttaacaacgaacggtccatctaaagcgaactcaaccttcgctttcaattcgttggacgttccggtatacaatccatagctaaaacataaaaagtaacttccttcgtgatgaagacaacttaccagcttctcagcctcatcttttgatctataagatgttatgcataaaggtaaaaaggccgaattgctatccaattttttgcagtccgtttcatcttgtcttgccattttacgtggcaatggctagtgcaatatgcaatgcgctaacgctgacattataacacaatatatttttctaccctccctttcgctgagttgcgaccagaatgtctgtttttcagtcatgtatttctttccgctttaggcgttcaggcaagcgcgttcagttgaaagcaaatagaacctataacgacgaatacgcttaaaggaagtatacaggaaatagaaaaagaagcgtactgcatgtactaaaaaccaaaaaaaacaccacatcggctctctggttgtatccatactttccctaaaattttgtaactcaagaaaatacctacataaaacgataatcagtggattgcactgatcaagtcgaaaaactccgtacatgcccgtctatccctgtctcatccatataaactgaactaggtagaaaaaaatacctaccctttctttaaccgcctggtatattaaataccattgtcaattgagaagctaacagccattgtaagagttatgtccagtgtccgactaagacaaggtaaccatacgttgatagctatgaataccccagaggaagattattctttctcataaatcctttttattggtttcaaaaatccaccaataagttcatatagcttgggcggctattcatgcgtaatataatgtgcatgaagtacgacccatcgactcttagagcaaatgcttcctaaattgaaataactagccgcctttaattcgagccttcttgtcatcttgtgtatttcatcctttcaacttctcctgttccacctttcactctaagcttccctatcatttggcctctttcaggttcgtccatagcgcatctttttccttttagacactccataacggaccaatcagcgttttgcgccatttatcggtcttgggtcacgtgcggcgacgcggaggctcccttataaggactggaaaaagacctgcaagaactatagttggttcttgaatatcaagtaatatattacttctctgtcgtaactttttgttgctttcaagttcaacgtcttttaaaaaccaagaaattattgaacataaataatatcactctaacacttattaggaaaccgaaaggagcaataacaaacatgttaggaataagatcatctgtcaagacctgcttcaagccaatgtctttaacttccaaaagactgatttctcaatctttgctggctagcaaatccacgtacaggaccccaaattttgatgacgttttaaaggaaaataacgatgctgataaaggccgttcttatgcttactttatggtcggtgctatgggtcttttgtcatctgcaggtgccaaatcaaccgtagaaacctttatttcatctatgaccgctactgccgatgttttggctatggctaaagttgaagttaatttagcggctatcccattgggtaaaaacgtggttgtcaaatggcaaggtaagcctgtgttcattagacacagaactcctcatgaaattcaggaagccaacagtgtggatatgtccgctttgaaggacccacagaccgatgctgacagagtcaaagaccctcaatggttaattatgctgggtatttgtactcacttaggttgtgttccaattggtgaagccggtgattttggtggttggttctgtccttgccatggttcacattatgatatttccggtagaatcagaaagggacctgcccccttaaacttagaaattcctgcttatgaattcgatggtgataaggtcattgttggttaggtttgtttttcgtcctcgaaaactacatctttattgtctatttgtttcacccttattttgatttttcatttactatccattatgttatgaacgggaactatacaactaacctaagaattttgaaatcacaacaaaaataatcaacatcacagtctcgaagggattacgctcaaaaaggaacgaaaatcactatactgtattccctgttgattttcctaagaatatattcttatacaatatggagaaaacaaaaggataagaaaagaaaggggaaataaagaagatttggacctatttattactacttttttgtctcaccatcttctttttctattcataatatttgatattcctttatttatctgcatgtatttataattaacgaaactatttatcttccctcgtcctgccttatccttcttttctccaaatgttttacctaagattggcctgtatttgaatattgatgtccagaagcagaagatttcacatgttgtataaagtatacaagattgtaaaaatgattgaagtatttttatatatgtatattacctataaaattttttatattacgtaccgaaggggtttttttaatgctaaagcgattcatcttgctgtaggtatatttttaaatcatctggaatatctgtccaggaattactatcccagtccatgaatttcttttttaattgggagtatttactgtcaaataatcttgaattgtatgtcgttgcaaaataacttgctttttgacccatgtggagttcctgcccttcctcattatcaaaaaagcccccattgatttcactcccgttgctattatcttgcttatcatatttatttgaaactttattactttttaaatcaataccttccaaatcttggaacaattgccttacatattccggcatattgtccggtctatacctacgatcaaacttaattctccaatagactgaccaatgtaaactgacatattcgggtacataacgagatcttccgaggttaggtgtatgaaaattttgccactttccttctttattttccattcgtattccaatggggagcagttccaatacccaccacaccaatctcataaatttatttgcatgtccacatttaagagtaaaagcatccttcactttttctttttcatctttcaagctcaatctagtctcttttatattttttagacaatcttccattctctcatttctgccagatttatcctctcgggctccatcctcattatcactcactcctagtagggaacatttctttggtgagttgaaactaaggtaatcatgtgtgtctgcgaataaagatccaatcgaagtgtgtttggtagcgaaatcatgtattgcaccaggtttgaatttaacaccaaatttgattgcctctgctaaaatccatcgcagcgttaaatttgacaagttctcttctgtctcacagtcaggcgcccaacctccaccaacgtcagaatgatcacctggaaaccatttttcaatcaagtcgggtgtcatagtcattctacttgatgtaccgctgccttggatagattgaagttggaaaatggcttcaattcctcttgttgaacattctgtatctctcgcgtatgaattaccttctaagaatgagttcaggtccaacagcaactctgtagtttcctcgcttttgctcgataacaaccttccagggttatcaggaatgagtggagaaggattactaatagaatgtgcgccactttttaaagtgtattttatcaaaggattttccggggttagatcacgcattaatgcattagaagttggcaccggcgaacactggtcagttatatgattacaatatgtcaatgaaaatagtttcggaatgtacggcatcggagtgaaacataactgcttgaattttccacgtctttcatccaaggatacgcaatgtcgaacatgctcaacgatattgcttctctgggtgcaaggaaacaacctgtcccttaatattccaactgagttcacagaatcgaataagccttgaaaatgtatctttacctcgtaatccctagagaatgttttcttgaattcttcagccaaggtacttgtgtactgtaattcattaggctgcgaatcgtattcccatttttcatagatttgccatgccattttaaccatttcttccaaacctttactcaaaagtccgactctttcaatcattccagcaagaactcttgcaataaaagctcctctagaaaagccaaacatataaattctatctcctggttcaaaatacttcatcaaaaaaagatatgcagaacatatgtgattgtctaaactgaatgcgaacatagaatctaataaattttgtaagtgagaaatagttaaccgtcttctgacatcaacaacagcgtcaaatccaactgaaccaattccaggttggtaataacaaatttgttcagaactatcaccgttctcaagaaggttgtacaattttaaaatattagtgaatggctgaggtccaaaattttctcttgttccatcaaaacaaagaatgatattcttgccagacgatgaatgtgaggatggatttatacttctgtcgcctcccgtcccattttttttatattttccatgaatataattgaagctatccatctaatggatattatgttagtgtattattttttataagttacatcacctgtttgctgttattttactacatctgtctgaagtacattaatttgtggcggtttaacagtatattgaatgtgacaaacacacccagacacctcaatagacaacaggagggccattaccataatttcataacattaaatattccaagtaacatttttcagaagacgaagaaagactaattaacaggataataaatattaacattatcttttaagtaccatacttgaagcgtcaattgatgtatgtttggttttccactattttcctaaaagcatgaatcttttctaggcaaaaaattggaatgacgactcctgatcgttaaaatggaagacaaacactagaagttgacttcaaaaaaacttctttcattaaataagggaaatatccggccggctcatactgataatataccagcaacatttacaggaaactgcaggttttaggcagtgtggcgaaccgcaaataaagtaataaacaacaatttcaaacggaaaggactcctctgctaaagatttgatgtttttaagttcttttatagtttatattggcataagaggtaaaccatatttagcacttattttcataaagtattagaagtgttcttatatatttcattacccgacttgaaaaatactacgcggttcattgcgagaaccttcaataagtgtcgaaagagcacctacattggcgtttaaataataaacacaccaacctacatattacgttgaatttaaattctttcactgcttgtaaaccatagacaataaactgattaatttagtatctaaaaaatcttttaaagggaaagagaagaggcggaaagatgagtgatagggaattcgtcacggtagatcccgtcactatcataatcaaagaatgcattaatttatcgacagcgatgcggaaatactctaaatttacctctcaatctggagtggccgctttgctggggggaggaagtgaaatatttagcaatcaagatgactacttggctcacacattcaacaatttgaataccaacaagcacaatgatccatttttatctggattcattcagttaagacttatgttgaataaactgaaaaatctagataatatagattcactaaccatattgcagccatttttattaattgtgagtacaagttccatttctggttacatcacttccctggccctggactctttgcagaaattctttaccttgaatatcatcaatgaatcatcgcaaaactatattggtgcacacagggcgacggtaaatgctctaacacattgtaggtttgaaggatctcaacaactttctgatgattcagttcttttgaaagtcgtgtttttactgcgttcaatcgtcgactcaccttacggagatttattatcaaactctatcatatatgacgtattgcaaacgattctttcattggcttgtaataacagaaggagcgaagtccttaggaatgctgcacaatcaacaatgatagccgttaccgtaaagattttctcaaaactaaagactattgagcctgttaatgtgaatcaaatatacatcaatgatgaaagttacacaaatgatgtattgaaggccgatacaattggcacaaatgtagaatccaaagaagaaggaagtcaagaagatcccatcggcatgaaagtgaataatgaggaagctattagcgaggacgatggcattgaagaagagcatattcattcagagaagagcacaaatggcgccgaacaactagatattgtgcaaaaaacaacaagatcaaattccaggatccaagcgtatgctgatgataactatggattgcccgtggttaggcaatatttaaacttattactatcattgattgcgccagaaaatgaattaaaacattcatactccactagaatatttggcctagagttaattcaaacggcattagaaatttcaggtgatcgattgcagctatacccacggctttttacactgatatcagatcctattttcaaaagcattttgtttatcatacagaacactacaaaattatcactacttcaagctacattgcagctatttactactctagttgttatattgggcaacaacttacaattacagatcgagctcactctaacaagaatattttctattcttttagatgatggtaccgcaaataactcgagttctgaaaataagaacaagccatcaataataaaggaacttctaattgagcaaatatccatcttatggactaggtcgccatctttttttacttctacttttatcaatttcgattgtaatctcgatagggcagacgtttccataaactttttgaaggctttgactaaattggccttaccagaatccgccttaactaccacagaaagtgtaccacccatttgccttgagggattggtctccctagtcgatgatatgttcgatcacatgaaggacattgacagagaagaatttggcaggcaaaagaatgaaatggaaatcttaaaaaagagggaccgtaaaacagagtttattgaatgtaccaatgcattcaatgaaaagcccaaaaagggtattccgatgttaatagaaaaaggtttcattgcttccgactccgataaagatattgcggagtttcttttcaataataacaaccgtatgaataaaaaaacaatcggtttgctactttgccatccggacaaagtaagcttgttgaatgaatatattcgtttgtttgatttttcagggttaagggtcgatgaagctattagaattttgttgacgaaatttaggttgcctggtgaatcgcaacaaattgaaagaatcatcgaagccttctcgtctgcgtattgtgaaaatcaagattacgatccatccaaaatcagtgacaacgcggaggatgacatttctactgttcaaccagacgctgattctgttttcattttaagttattcaattattatgttgaacactgacctacataaccctcaagtgaaggaacacatgtcatttgaagattactctggtaacttaaagggatgctgtaatcacaaagacttcccattctggtatttggatagaatttactgttcaatcagagataaagaaattgttatgcctgaagagcaccacggcaacgaaaagtggtttgaagatgcttggaataacttgatatcttcaactactgttataactgaaataaaaaaagacacacaatctgtcatggataaattaacacccttggagcttttgaactttgatagagcaatttttaaacaagttggcccaagtattgtcagtactttattcaacatttacgtagttgcatctgatgaccatatatctaccagaatgataacaagtttggacaaatgttcctatatttccgcattttttgacttcaaagatctctttaatgatatactaaactccattgctaagggcactactttgattaattcaagccatgacgatgaactttcaactttagcttttgaatatggcccaatgccactggtgcaaattaaattcgaagacactaacactgagatcccggttagtacagatgctgttagatttggtagatcatttaagggtcaactaaatacagttgtttttttccggattattcgcaggaacaaagatcctaaaattttctccaaggaattatggttaaacattgttaatattatactaacattgtacgaagacttgattttgtctcctgatattttccctgatttacaaaaaagactgaaattaagcaacttgcctaagccatctcctgaaatttctattaacaagagcaaagaaagcaaaggtctcttatcaacatttgcttcttatttaaaaggtgatgaagaacccacagaagaggaaatcaaatcctcaaaaaaagcgatggagtgcataaagtcgagtaatattgccgcctctgtctttggaaatgaatcaaatataacagcggatttaataaaaactttactagactccgccaaaactgagaaaaacgcagataattccaggtattttgaagcagaacttttatttatcatcgaattgactattgcattatttctattttgcaaagaggagaaagaattaggaaagttcatacttcaaaaagttttccaactttctcacacgaaaggcctcacgaaaaggactgttcgtagaatgctaacatacaaaattttgttaatttcgttatgtgcggatcagacggagtacttgtccaaattaataaacgatgagctgttaaaaaagggggatatttttacccaaaaattttttgcaactaatcaaggtaaggaatttttgaagagactattttcattgaccgaatcagagttttatagaggatttttactaggaaatgagaatttttggaaatttttaagaaaagttacagcaatgaaagagcagagcgagagcatttttgaatatttaaatgaatcgatcaagacagacagcaatattttgacaaatgagaacttcatgtgggtcctaggactattagatgaaatttcatcaatgggtgccgttggaaatcactgggaaatagaatacaagaaattgacagaaagtggtcataaaattgataaggagaatccatacaagaaatcgatcgaattatcattgaaatccattcaactaacatcacacttgctggaagataataacgatctgcgtaaaaacgagatattcgctattattcaagctttggcacatcaatgcatcaatccgtgtaagcagataagtgaatttgcagtggtaacgctagagcagacgctcatcaataaaatcgaaattccaactaatgagatggaatcggtagaagaattaattgagggcggattactaccgttgctaaattcgagtgaaacacaggaagaccagaaaatcctcatttcatccatattaacaataatttcaaatgtttatttgcattatttgaaactagggaagacaagcaacgaaacgtttttgaaaattttgagtattttcaataaatttgtagaggactcagatattgaaaaaaagctacagcaattaatacttgataagaagagtattgagaagggcaacggttcatcatctcatggatctgcacatgaacaaacaccagagtcaaacgacgttgaaattgaggctactgcgccaattgatgacaatacagacgatgataacaaaccgaagttatctgatgtagaaaaggattaaagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggcctttataaaaaggaactatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagcatagcgaacgtgtagggcagcgtttccaagaacaaaacgctgccttgggacaaggcttgggccgataaggtgtactggcgtatatatatctaattatgtatctctggtgtagcccatttttagcatgtaaatataaagagaaaccatatctaatctaaccaaatccaaacaaaattcaatagttactatcgcttttttctttctgtatcgcaaataagtgaaaattaaaaaagaaagattaaattggaagttggatatgggctggaacagcagcagtaatcggtatcgggttcgccactaatgacgtcctacgattgcactcaacagaccttgacgctcacgccgtagcgggcgacaagtcaaacggaacaaccgttgccgttcccatcggagtccgacctaggccgaactccgtgaatttctgataacaacggtcggtaaagactggttccccagtatatttcttctctcaggagcaggggccaatgccaaaagcgacattaacccggaggacaaggctccactgtgttccaccgaatttcccacctgataatatctgataacccgcccataggtggggatccttctgtaaacaggtttcttaatcgtaggaattaccactgttccactgccaatcgcagctcccagagtttcgttcccagccgcgagcaccacagcgtaccatgtgcgccacgaggcctcaaacgtaaaacaatcgaaacgaaaagaaacagactataggggagtatagagacagccggccaataagaagaggaaaaagaaatactagcgtttatcaatgtgggtcgttaacatatcctgttgacaatgattacaggttaaaaggtagcgtaagtgaatattaactatggatattcttatacttagataagagacatataaaacacacgatgattgattgatttttatgaccaatatatgtaattcgtaattcagatagtttttatacttttaatgtgtgccgaaccatattactagtatatgtaactaccatgttatgttcaattggcagatctttaactcggctttagttatccaagttacttgcaatatttccttctgcgagagtacatttgcccttaaacgtatacgaggtattcattaatgtgtgttgtaagtatttagattgacatctataagagagatgaacatatatatatatatatatatatatatacatgcatatttactataaacgcggtttattctgccaggcaaaggcaatttgcttttgttcgccaggctcaatgataacgttgatgacacttgtttctcttttagtccgagaaagctgcacggcttgttggaagcatctgctcagttcgcttattgtgttgacaaaaaaatcattggcacccagtcctttgcctacgagatcgtaacggcagttcttgcttagtgccgttggaggtaaatcaccctctatatccttttctccatggtaaataccgctattgttcatcacaacgatgaccaatgccagctgacaccttactgccgtttcaatttccatggcagagaatccaaatgcggaatcaccctgaatcagcaccacatcgagttccggatgagatgccttgcatgcaagagcatatccgagcccaatccccatagtcgcgttggtccctgcgtctaaacggcgccttggagcgtctgtagggaatgaaatacgcgcaatatccatagtatttgctccctccgtcacaagtattgtcctgtaatcatcgataagaggcctcaatgttccataaacctggttgtaattcaattgtgcccctctagtcttctctttcctcaatagacgagtttgattcagttgaattttctctcgtatttcttgcttaacaccactatacttccagcaggaatcttggcgagtcaattcctcaactaaagcggttacgctcaagcctatatctccccatatggaaaggtcagcaccaggtgagacattgttatcccccaaggtttcgggattggaatcgaactggatgaatatggattctgagttccatttgggtgaagtaccaaaatgcaatatccagtttaatcttgccccgagaacaagaacaatatccgctattttcaatgcttgagatcttgcagatgaaacgttcagtggagaagagtctgggacaattcccttagccattggggtgggtaaaaatggtagattgaacgtatttactagtctgcggatttcgtgtgagttttttaccgcaccctttccaataacaatcagaatatttttatttttatgttgcaaaataagctgtacgacttttttgatcttcgacggatcagggccacatatgtttggagttaatatcatcggtaattcatttcctgtacggtcgtttccttctaagggtttttcatactcaataaaatctgcagggacgtctatgtaagaaacccctgcagtgccttgtatacagtaattcaaagccttctgagtaatcatgtcaatattgtcaggggttaactttccggtaaacttcaaaaatggggacaaaagactaacttgatccaactcttgaaacccgcctttatgtatatcactttgagaagaactccctgcaattactagaagaggccacctattactcattgagttgtatataccagccagtgcgtggattaaaccggggcccccgacaataagtaacacgccgggcttatcactaatataaccataagcagaggctgcatatgaggcagcctgttcgttcctgcatggaatgaatttgataccgttggcaaccatcgtatccgctagttggacaatagggatgcccacaattccaaagactgtgtcgatgccatatttttgtaaaagttgagcgaagtgttgggtagcggtcgtggtcatattgatggatggttgtgacggtttgaatgtagagagtatattcttcttatcacataaaagtaaccaatgccttttttttcctttatatataatgtggttatataccaaccttttgtaaatttccaacttttttctttagttagctttgcttgaacttcgggccgaagggctcggataagagaaacaataattttgttttcataaaacatcgatggcttgactacttcttttatcctgttcctgagattctttcatcttggcgatcttacaccttagttccataatagggtctcttacaaaatccctcattgaaacgacttgagaacacgctgcttgcgggcaatctcttgtcgtgtatccttgtaaatagttttgaatgccgtctctatcgaagacgtgattacattttcttgatatcaatggtgcttcgtaaggtttgcaggtgataggacaagtcaattcaattttaccaccttctatttgtagatcgtcttcgtctgcggggttttgcagatccggtattacacaagttggatcattccatatgtacggcaacacttttagtatcttgagtgtatctgtgttattaaccatggttgcaggctctggtgtgggcatatttagatataattcagataatttgggagcggtgagttctccggtacgatatttatcccaggtagaaaggtcgatttgcggacaggcatctgaggattgtttgaaatttttttttaaatctttaatatgttcgtcaaatgagttggattccgattcgtatgtcgagaggagtttgtaggtgctagtaatatctgcgacctgctcttcaatgccgatggtggaaggagatgtagaatccactaattgatttatggtctcatcaatttgtttgtagcattgttgatatatatttgataagtctcgggcatgtaaattatggaagtacttacctgattttgggtgtagaggaactgacttgggtataggattatcgttcaaggccatttttaaagttattctttttttatatagtcttgccttggtttctttaactgacacgattattttagcaagtttttttctacacaggaaaagaggaagaaaataaccagagaagcactggtaaaaagatacttctgcgtgccggagtaaccagaatcaaaggaacgcatagatggataaagaggtaagtgaattggtagtgttgcagctaatacacactttaatttccaacaagaatgaagaactggttaggaacgggggaggaatcaacatgattgggaataatcttcgaatatcgctagtcaagttgactaacgaaatacaaaacaatttgctaatcaacgagctgacaaatttaagaaggcaaagcaacgtggcaaatggaaacaggaaactgggcatcaacgatatcctgaccatagttaagaatttattcccagagtacagaacaacactaaacgatggacaacttagtctacacggtttggaaatgcatgatatcgagaagctccttgacgaaaagtacgatcgattcaagaaaacgcaggtcgaacaaataaggatgatggaggatgagatattgaagaacggtataaagaccggtgcatcgcaactgcaaccacatgcaaatgctggcaaaagtggatctgctggtaccagtgctactataactacgactacgccacacatggcgcattcaatggacccaaaaagagaaaaactattgaaattatacagagataccgttctgaataaattggaaagtaaaactgggaattttcagaagctattcaagagtcccgatggtagcattatcaagaatgagataaattacgaagacataaagaacgaaacgcccggcagcgttcatgaactgcagctgattcttcaaaagagcataacggacggtgtaatgcgaaaggtcattggtacggacgactggaaattggctagacaagtgcagtttgaattggatgatacggtgcagttcatgagaagagcactagagtaaggagatagtaggcgacacttcgaaaatctaaagtcttgtaacattactattatatactattttattaaaaaaatacacacacaattctttaacagaacaatatataacaaatgaagcgacatgtttctcaaaaaaaaacatagtaggtaggtaaaaatgggaaagaacgggacaaacaaaacgaagagcagggtgtatttgcccacacacggcaaacaacatccattcacgcccgcatgcccaaaacttttttgcgataaaacgcccacgcaaatcacatcgttccaacagaggaatcgaacagcacagatacaaagtaggaatatagcacacacacaggaaaaattaattaattattagaaattaaaagggttggggagaaaagaggtctaatttattcattaatattcagtaattgaaaaaaaaaaaaaaaagaggataactaagagaaaacaacatcaagctcgtttggcttgctagtgatcgcttagaatctttgtaaacctctttgtctagcttgccattttctgtagataatggtagaaatgatggcgatacaagccaaaccgactagaataaaaactaagataacaccacctggtaacgtgctcatcaacatctttgtataattgttattgtactatttattgttttgtatgtatacgatggagaaaaagagaaaggaagaaggaaggacgaaagagaaaaaactggaagggaagaagaattgattttatattaaccaagaggaaggaaaggaaattgagttgtgattacggaattttagtttttttcactgtttatttaaaccaaaaggtgtggaagagaaagagagaaaaaagttctgtaattcgttaaggaaattaagtatccgcgccggaaaaatagcgagaggttttttttgatgcaaaagctagggagggctgcggacggatttcgaaaacagctcaacagcgtggtgacgagttgcgtcagggtgttggccagtgctaccgcgggcggcgctgcacagggagtaagcagagcgggctagagcgcggttttggagagggcccgggctgctgtggtcgtaggattgcggtaatttagtggctcgccctcgtttgtcgtgctttttccgagttccgaaactctttcccgagctgttaatgtgctaaaagtggtaaatcgtatatgatgatatacgtatatgatgataatttcctgcgcgctacttgcgtgcattcgtcactcataacaaaaagaactacacaatacgtaaacaacgtgcgaaaatatctatatacaaggggagaaaacaaaagtgaaagtgcattacagcccatcacagatcattataatacaatatgccgaccaagtcaacttttagtcgctggaagaaggcggacctaattgacctggccaacaagctggaaattgacggcttccccaattatgccaagaagagtgatatgatcgattacctcgaatcgcacttgaatcatcttgagaaacctgtggattttaaagacgactacccggaactaaggtccttttatgagtcgatgacagtggaccagtcaaaggatgaacggaacgaatacggatccggatctggaaacgggtctgggtctggatcctgtgacaccgccacaaatgattccgatctggagaaagcgtacatcaaggaggatgatgatgagaaaccgcaatcaggcgatgaaacaagcgcgacaaagccgctttccagcaggaatgcaaattcaaacgccaaaacgaacttcaatttgttggattttagcacagataacgactcgtccacctctgcgtttactaagttcaagtttaactttcaggaatacctctccgatattagataccaaacgcagaaattgaatgaaaatgttcaggactatctttccactatttccgccgtcgatacgattttttccttgttggaattctcttttctggtgagaaacatattagccgccgggcagccaacttcttcttcttcgctcgcatcgtcgctggaagccgccgttgccgcccataataaatatcaatacacgctcgatttctgtttaccaatactcacgtggctgctcttctttaggggtattccaacgttagtgtcatactacatcaacttcatccgctacgacctgaacatcgagttggacccgatgactttcaatctcacgaaattcttgatttctttggcaatcttcaaaacttgtaataataaaaacatagatttccattcttttcgatgtgttaaccaactatggacacaactctgtacagtgaaccgttcccttggtatggtacctctagtattctccatggttagttgtctcctcactctatacgtattatagtatattttcttacatacgtatacacacgcgtacgtaagccgcgaagtgtgtatttactactctgtattattgtaataaactcttctccttctttgtcttttcttctcccaaaagcgcacttgccttgatcagcatattgtatacttcgatgttttcaaatggaggtacgacttcattgttgaacatcggacccattccaatgaatatagatgccatatcactacagttgttaaagttgtatccatgtgtgcccataatgccgataggcacatcacccatttcttttacaatggcgtagtattcatctgcgagaatccagatatcgccgaccctatcgtcatatctgtgctttctgttatcgtattggaaatatttccagctcgggtcgaaatcttctttcaggatcacgtgaaacttcctcgatatttcatctccatatgctttctctaactgagcttcaatcaagtcacaaatccattgcttgtctcgagggtttttcaaacataccatcatcatggggccctcgttataaagatgcgaaataaatgcgctcattgcgtcggccgggaacaccctttcccacacaacaacatgctcaccgtcattcgcgttgacattgctcatgccatggtcactaacaatcataacattgctaattttcaacaagtttcttttttgcaggccttcaatcaaatcgagaaagaatccatcgacttcaccgatcagcttttgtagccgcttatctcgtaaatcgtatccaaaactgtgtccgtacgaatcaacattgggtatataacttatgaccaattctggcctatctttaagctgaggcatatctatgtatcggaaaatttgagctaatttatcttgaagtttttcccattgattgaatttcccaaaataaaatggcattctttccctaggtacatccccgtggtcctcatacacaacctcacttccaggccacatatgcgtggccactttatattcgccttgcgattcagtttgcagtagttgccaaatagggtcagccgtgttgctccaaattcttgcgtcgaggttatttggtctaaattcgctactcgtgaaattatcccagaatatattggaaacaataccgtgctcaatgggatattttcccgttaccatgctccagtggttgggaaatgtctgagtgggaaaacttgggatcatatacggtgcagtcgtgatattcatatcgtacggggaccgcaaattgtgcaagttgtaaagaaatggcgtgtattttgcatctatcaatctcggatggaacccatcgatagatatcaatatcgttaacgtcttgaaatcatgtgtgccgttgaagtaagtatttgatctattcgcaattgtccggggcccattatcaataggttttgggcacttcgaatataaaagcaactcaatgagtattataccgcaaagcaaaagtttcaataaaaaatgtcgtgatattgcgaaaggttttatgttcgtatcatcttcattatttttttcaaggtcaacaggttgctcgaaaagaagcatatcgtaagcacacttcgaaatggccttctttgttatttcgaaactgttttgtggcctgcgtgtttaatgaaccctggtatcaagcgtcacagtcatataaagccttaaattatcttccatcaacgcacagtaaaccgtctaattgatagaaaaactctcaacccagttatcgagtgtcgctacactctattgtaattagctgcaatcatcttgtttattaattatgtcattttattaccctggatttgaagcccgtctctttttccgcttgttttttttttttcaatcgctgagaaatagaaagaaaacatagttagctcgaatagtttagtcaaaaggcctactattgactgctttttctgcaaatccatgctctcaagacaatacagtaattcgtaaaagaaaccataatgtcacaatttgttggtttcggagtacaagtggagctaaaagatgggaagctcattcaggggaaaattgccaaagcaacctcaaaaggattgactttaaatgacgttcaattcggcgatggtggtaaatctcaagctttcaaagtgagggcgtcaaggctaaaggacttaaaggttctaactgttgcctctcaatccgggaaaaggaagcagcaaagacaacagcagcaacaaaacgattataatcaaaatcgcggtgaacatattgattggcaagatgatgatgttagtaagataaaacaacaggaagatttcgatttccaaagaaatttgggcatgtttaacaaaaaagacgtcttcgcacaattaaagcaaaatgacgatatattaccggagaatagattacagggacataacagaaagcaaacccaattgcagcaaaataattatcaaaatgatgaattggttattccagatgcaaagaaagattcatggaacaagatttcttcaagaaatgagcaaagcacacaccaatctcagccgcaacaagatgctcaagatgatctggttttggaagatgatgaacatgaatacgatgtcgatgatatcgatgatcccaaatacctaccaataactcagtctttgaatattacacatttaattcactctgcaactaactctccatccataaatgataaaacgaaaggtacagttataaatgataaggatcaggtactagctaaattaggccagatgatcatcagccagtcaagatccaactcaacatccttgccagctgcaaataaacaaacaaccatcagatcaaagaacactaagcagaacattcctatggctacaccagtacaactactagaaatggagagcatcacgtccgaatttttcagtattaactcggcagggctactagaaaattttgctgtaaacgcatcgttcttcttaaagcagaaactaggtggccgtgcacgtttacgtttacaaaattctaatccggaacctttagtagtaatactagcctcagattccaacagatctggtgcgaaagctctggcgttgggtagacatctttgccaaacggggcatatccgtgtcataacattatttacatgttctcaaaatgaactacaggattccatggtcaaaaagcaaacagatatttacaagaagtgtggcggaaaaattgttaatagtgtatcgtcgctggaatctgctatggaaacattaaatagccctgtagaaatagtcatcgatgccatgcagggatatgactgtacattgagcgatctggcggggacgtcggaagttattgaaagcagaattaaaagcatgatatcatggtgtaacaaacagcgaggatctactaaagtgtggtctttggatattccaaatgggtttgatgcgggatccggcatgccagatattttcttttcagacaggattgaagcaacaggaattatttgttctggctggcctttgattgccatcaacaacttaattgcaaatttgccaagtctagaagatgctgttttgattgatataggtataccacagggcgcctattcacagagaacttctttgcgtaagttccaaaactgtgatcttttcgtcactgacgggtccctgctattagatttgtaaaccaagaattactttagcctaaactggatacatacgtataagcatacggtaaggaagtgggatctgtagcggtaatgcaataatgtgttggctctcacaaatatgaaaactgcgaacatctatataataaggtaacggtataacagaaaaatctgaataatttctctttcccgggtaatgagcccttaaggaggactcaaaacgaaaaggaaaaaaatacgagtggaaagaaaaaatgaaccctttccagtaattgataataatacaatcattcattattagaaatatattagttctcaattcaaggcagaatagtgctgtcattgtgatcaaatttttgtgtgagtctgctttgctttctgtttttttttgttgactcgctgttcaatctcctacttttccttttgttgttaaaataaggtattatatatttatacaaccctataaaaagcaattagccaatttccaatcctacgaagacaggaactgagcaaactataagggtgttctttcttctgtactatatatacatttgcaactatgggttcatgttgtagttgcttgaaagattcttcagacgaggccagtgtctcaccaattgccgataatgaaagagaagcggtgactttattactagggtatttggaggataaagaccaattagacttttactctggtggtccactaaaggccctaactactttggtgtattcagataatctaaatttgcaaaggagcgccgctctggcattcgcagaaattactgaaaaatacgtccgtcaggtctctagagaggtactggaacccatcttaatattattacaaagccaagatccacagattcaagtggccgcttgtgcagccttgggtaatttggccgttaataatgaaaataaattattaattgtggaaatgggaggcttagagccattaataaaccaaatgatgggtgacaatgtagaagttcaatgtaatgctgttggatgcattaccaatttagccacaagggatgacaataaacataagattgctacttctggtgctttaattccattgactaagctagctaaatccaaacatataagagttcagagaaatgctacaggtgcattattaaatatgacacattctgaggaaaatagaaaagaattggttaatgcaggtgctgtgcctgtattggtatctttactgtcgtccaccgatcctgatgttcagtactattgtactactgctttatcaaatatagcagtggatgaagccaatcgcaagaagttggctcaaactgagccaagattggtttccaaattggttagtctgatggattctccatcttcaagggtaaaatgtcaagctactttggctttacgaaacctagcgtccgatacaagctaccaattagaaattgtaagggctggtgggttgcctcatttggtaaagttgattcaaagtgattctataccactggttttggctagtgtggcatgcattagaaacatttctattcaccctctaaatgaaggtttaattgttgatgcaggtttcttaaaaccattagtaagattgttggactataaggattcagaagaaattcaatgtcacgccgtatctactttgagaaatttggctgcatcatctgaaaaaaacagaaaagagttcttcgaaagtggtgctgtcgaaaaatgtaaggaactggctctagattcacctgttagtgttcaaagtgaaatttccgcatgttttgctattttagccctagcagatgtctccaaattggatctactggaagcaaatatcttagatgctttaatccctatgactttttcccagaaccaagaagtttctggtaatgctgctgctgctttggcaaatctatgttcaagagtgaataattatacaaaaattattgaagcatgggatcgtccgaatgaaggcattcgtggatttctgattagatttttgaaaagtgactatgctacctttgaacacattgcgctatggacaattttacaattgctagaaagtcataatgataaagtggaagatttggttaaaaatgatgacgacatcattaacggagtgagaaaaatggcagatgtgacctttgagcgtttacaaagatcaggaattgatgttaaaaatccggggagcaacaacaatccaagctcgaatgataacaacagtaataacaatgacacaggatctgaacatcaacctgtagaggatgcaagtttggaattgtataatattactcaacagattttacaatttttacattgattttcttcaaaagcgggactaggcattataatttttatcaaaattttcttctcagaagttttattttctttctctccatttcttccatctttttaatctttgtttcctttttttacatcatattacttctacctactctactctattctaatttcaattgattttttttattttatttttttttttgttaataaaagaagaaaaaacttaaaaacgaataagaggctgtctttgttccgtagtatatgcctatttccttctagaagtttgaagtgtcgtaaattttacctacggataatgttcgttacattgttgaatggcaactgtagtgaggtaatgttcaaaaagtgagaaagcgggagagaagggctacatacaaaaaccaattctagataacatctatatcttcgtttttagaatatattgtaataaaacacaattgataatacagttctctcttcgtcctctgatggtgggagatctattaaaaatacaagttagctgagcgggggaaaaaaataggtcttacccggattcgaaccggggttgttcggatcaaaaccgaaagtgataaccactacactataaaacctcttaattattgatttccacaataattttatcatatatcaacactattcttcacatagtttttttaatcccggtgtctctcatctgctaatgaaaatacgttcactcatatttcatgcaccttccagtagactgacccttcataaggttaagaatatcatggggaaattatcgcaatgcatgtctcttaaagaatacaagaatatataaaggcgaatcaacgattcttcacgataatttgttttcctcttaatcacacagcagtctgaattctatcagtggcacattaatccttgtttcaatgctcgtgtgcacatctgcgtaaatatacattcttacgttttcttatttaataatagtaggttgagcttcgtccaccgggtaatgctcccggagcagtggaattaaaaaaaaaaagggtgagcaccggaaacagctatctgcgcttaagtatcactaacgtaaagcataggtaggatttccagttctgccacatttgataaatagtgtaatccgtaattatcaagcgagatagttttcgaatataatttagaagtaagagcaaaatattaatagtatttcataaggaatattggaagaaaggagcgtaatacgaaagatgaggtatgtttgataagatatatacgtatatttatatatcactcttctgagaaagtatgccatagaatgaggatcactaacaaagaaaatgtcaatgaacttcaaagatatcgtttaatgaaacagtagctctaaaagaaggatcgagacagatgttatgaaactgttgatgagtgatcatcaagtggatttaatcaatgatagcatgcaagagtttcatgtaaagttcttgggaccaaaggatacaccctacgaaaatggggtttggaggttacatgtagagttgccggataattacccatacaagtcgccaagcatagggttcgttaacaagatattccatcctaacattgatatcgcatcggggtccatatgtttggacgtaattaactctacatggtcgcctttatatgatctgataaatatagtggagtggatgataccaggtttattaaaggagcctaatggtagcgatcccttgaataacgaagctgccacattgcaattacgagataaaaaactgtatgaggaaaaaatcaaagagtatatagacaagtatgctacaaaggaaaagtaccaacaaatgtttggcggagataatgatagcgatgacagtgatagcggcggtgatttacaagaagaggacagtgattctgatgaagatatggatggcactggtgtttccagtggcgatgatagcgtagatgagttaagcgaggatctaagtgacatagatgtcagtgatgacgatgactacgacgaagtcgcaaatcaataatttcgagcacacacatatatatatatatatatatatgtatgtatgtataagtatatatgatggcatactataccacacgtacgactataattacaaacaactatcaagcaactacaaggatctctgtgggctagtggcctgcgggctcaattttgctcttgttcctgaacggtgaattctgtagtctgtcatccaggggaagggcagggcactcatcaacaatgtgatagtcagaaagcaataatgttttgtattctgatgagctttcactatctcttccgcaatacccctttttgcctatattacggcatcatctttccccgcgttctcgtgggggccaaataagctttgtccaaggggctgttgcaacggtaaaggtagtcgagccaagtgacaccagcaaacaaggaaacaaggaagcaaggaaggctttccattttccaataacgacatgagtctatctatggtgtataaaagtggcaggcttttcctacattttttttccctgataacttcctgttactatttaagaacaccaaaccaagtataaagaaccgtcaagaataaaatgtacaacattccagataatgtcaaaggggctgtagaatttgatccatggttgaaaccgtttgccgatgtactttctgaaagaagatacctagctgacaagtggttgtacgacataactcatgctacgcctgatggttcgtatcagtcactcagtaagtttgctagagattcatacaagtcatatgggttgcatgccaatccggaaaccaaagaaatcacttacaaagagtgggcacccaatgcggaacgtgcatttctagtgggagatttcaataactgggataccacatctcatgagctcaagaacaaggacgaatttggaaattttacaatcacacttcatcctttacctaacggcgatttcgccatccctcatgattcgaagattaaagtcatgtttattttgccagatggttccaagatctttcgtttacctgcgtggatcacaagggctacacagccttctaaggaaacttctaaacagttcgggcccgcatatgaaggtaggttttggaatccagagaacccctacaaatttgtacatccaaggccaaagtttagtgaatctgtagattccttaaggatttatgaagcccacgtcggtatttcgagtccagaaccaaagataaccacatataaagaatttactgagaaggtcttacccagaatcaaatatcttggctacgatgcaattcaattaatggctattatggaacatgcttattatgcatcatttggctaccaagtgaccaatttttttgcggcgagctcccgtttcggcacccctgaggaattaaaggagctgattgatactgcacattctatgggcatcctagttttattggatgtagttcatagccatgcttctaaaaacgtcgaggatgggttgaacatgtttgacggttctgatcatcagtatttccattctataagctccggtaggggtgagcatccgctgtgggattcccgtctttttaattacggaaaatttgaagtgcagcgattcttattagcaaacctggcattttatgttgacgtttatcagtttgatgggtttagattcgatggtgtcacatcaatgttatacgttcatcatggtgttggtgccggtgggtcttttagcggtgactataacgaatatctttctcgtgacaggtccttcgtcgatcatgaagccttagcttatttaatgttagccaatgatttggttcacgaaatgttgccaaatctggctgtaactgttgcagaagatgtctctggttatccaactttatgtttaccccgctccataggtggtactggtttcgactacagattagcaatggctttgcctgatatgtggatcaaactaatcaaggagaagaaagatgatgaatgggagatgggaagtattgtatacactttaactaatagacgatatggtgaaaaagtggttgcttattgtgagtcgcacgaccaagctttagttggtgataagacattagcgttttggttgatggatgccgctatgtacaccgatatgactgtattgaaggaaccatccatcgttattgaccgtggtattgctctacacaagatgattaggctgatcactcactcgctgggaggcgaggcttatttgaacttcgaaggtaatgagttcggtcatccagaatggttggatttccctaatgttaacaatggcgatagctacaagtatgctcgtaggcagtttaatttggctgatgatcccttactgcgttaccagaatttaaatgagtttgatagatcaatgcaattatgtgagaaaaggcataagtggctgaacacgaaacaggcttatgtttcattaaaacatgaaggtgacaaaatgattgtgtttgaaagaaataatctgttgtttattttcaacttccatcctacaaacagctacagcgattatagagttggtgtcgaaaaagctggtacttatcacatcgtgttgaactcagatcgtgctgaatttggtggacataacagaatcaacgaaagttccgaattctttaccaccgatttggaatggaacaacaggaagaacttcctccaagtttatattcctagtagagtcgctttggtgcttgccttaaaagaatgaactctatactatattgcttactgaaaatcaagactcaataatttttttctcttcatgtattggtagatatctaaacgtacataacaaaaaaagaaaaaagtaacttggggttaaagaataattgactttgggcgaatagcagagctgtcattactgctgatgcttttttcttattttcggagaaaaagaaagccctgtagggggctcgaacccctaaccttatgattaagagtcatacgcgctaccgattgcgccaacaaggcttttttcttgggaaaatctcttccaaggtttaacctatactgtctgtgtatgtctaaaacgaagcattggttgttcattgattgcaacagtaatgaataattagggttattgaagagaatgtggattttgatgtaattgttgggattccattgtgattaaggctataatattaggtatgtagatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacagttattagaggcggtaatctatgagttcacataaagtattgatagatgacgtaaattatcggccggtaggataagatccaacagttactaagttagtgaccctgaagcacagtgatcataatgtgttggaataagaatgaaacgccatcacctatcgactagtatttatattactggtgtatatcaaggagaacgtaagaagatgagacgtaaattcgagaaacaattatcaaatataatggaatgagagaagagtgaaacgtatataatgaaagaggaaatatctcaacgttcatctgtctctcgtaatgtgacagaaaaagaaaatcgatcaaaaatatggggaaatattcatcatgtagaatttcaaatattttcattgtaatttctaaaattaatgaggaaaattcgatatatctggtatcactttattattccttcagcacgaaatgtcgagcgatctcgatgcaggaaccaggtataagtagcgatagtaaatttttttctctctttttaataatccggaaagtctcagttgcgagtgattgcagacagttgtatgaatgtaaaaaaagtaatgaaaacatttgggagtatttcaaacggaggttagagacgaggctttcgagcttttctattattttaagtgctgtgtttccggacgtgctcttcactttcttattttcttgataatatttcctgtaaatgttacagcagaatggttgcaaactcaataaaattctgagggcaactggcagagaaccttcaattttggaaaacagaaggaaccgaagccaggcataacgttgttttctatattttttaagtaaggtgttcatccagtagagatcaggttacatcatagcaattcattcatgaataaagagtatcagttttttaaatgtacagtattagccgctgaaatgcaccaatttgaggttatttttgaaacataacttgaagagaaaagacagcattagggcgtttcttaactagcgatgacgtgcttcgattgagcggtaagtggaaagtatcagtctgtgtctactcgtttttttaagacattgtatataatatgttttgctggttagataaatgcgtggtgcacatataatggatacatccgtagctatggaatccgctttcaccaattgtaaaaaagtctacaacgacacatgctatcggataggaacaagcaacaaattggaaacgtatgagaacgaatgaaggatatccatcaggaagaagcgatcagttaaggcatcagaaatttctttcaatgaggaattgacaacgtgtttgtataagatctgattacctatgtagttcggctgcatagatttcagttacattcacattaaagaagcacgagcgcatattgtattgtgaaagtaggaatcaattaccatttaccaaatactgttctaatcactttaatactatgttatattgtgtaagaaaataacacaaattacgagaagtagtcattgaatgtagaaaaagctgaaatgcaaggattgatagcataatatgatgaatgaataaagacgtataaaatggaaaagaaataatatgttgaaatattagtttattatttttttatctaatcccaaggagaatttctagcgtattttacttgataactgaacctttcattaagaacgcaaactcaatgtttccaaatattaattcatttcccatgtatacctgatatcgttcaattccagaattcttacaaagcagatactataaaaagtgaaggggagcgaaatgaatacaactttctattattttcagacggttaagagagtacaaatgactatcctttttgaattctctagcttaaaatgaatagttgattcttttgccaaagacgaaaatagttgccagtaagcatctcttatgaaataagtgttgttgtgaatagctcaatagagatgtattattaataagcctcgtattttcagggatcatgcgtagcataatggcagttggtaaggggaataagaatgatgattccattattgcgaataaaggtatttctgaaagtacatctaatgggctatttgaaaatttgtttaggattatggtaataaaagaggcattaacgccagaacctttattttatcactttttcgatatttgttaataatctaaatctaacttatatctaaaccttagcgtttgcattcttgatttctatatttttattcacaatatggaaaggaaaaacaatctcttaggttgtccaagaaaacttctctccctgtcatactcaaagtgttggaacaaaaatcaactatcgtctatcaactagtagctatactactaatatattatcatatacggtgttagatgatgacataagttatgagaagctgtcatcgaagttagaagaagctgaaatgcaaggattgataatgtaatagaatttaatgaaacatataaaacggaatgaggaataatcgtaatattagtatgtaaaaatatggattccattttgaggattcctatatccatgaggagaacttctagtatatgctgtatacataatactatagccttgatcaacaatggaaccccaacaattatctcacaattcacccatttctcaactagtaacatgagtactcctaaatagggcgatattttaaagtttcattccagcattagctataacacgttaatatggtggagtcagctgagaagttttttcaataaataatgctcgcgtggcgtaatggcaacgcgtctgacttctaatcagaagattatgggttcgacccccatcgtgagtgttttttttatctattcctaaccagtaaataccagaacatacggcagattataaatgcgtggtgtaaaattctacttaagaaaattggcataaaaaagattaaattcttatctaagtgaatgtatctatttcgttatacacgagaatgaaataaaaaatataaaataaaaggtaaatgaaatcagcgttcgccaactaatttctttaatctggcaacctcattttccaagtgataatttttcgaaagcaattcttcaaccttgtcttcaagttgtttcattctttgcaactttctcgcacgagaacgcctggcggcttcagtgtttctagcacgttttagagcagcaggatcactggattcgggcacaattggagaaagtggaatcgaacgctgtttgcggttgtaagcaacaacacctagatgatccagtctcgattcgtcatcctttccaacatgatgtgacttcttaacgactgaatttggtttcttaacctttcttgtttgagtcagtttagcatcttctagaacaggagtgggtaagaatgaagttgtcgagacttccagattggatggtaccagagaaacttcttcagtggattcaattgccttatcagccaatgaaacatcgtcagtggtaactggaatgtcattgtcaaacaaggatgtccattctttagagttgtcttctaggttttcatactcaaacattggagttgaatcagtgcttgacgaaaagaaagattccactacagcgtcatctagctccggaattggcaaaacggtcttggcatcaggtgcagttgccgtttgtggaagagcaaaatcaaaatcaaggttcgaaggggtatcctgtttgataattggatcctcttcagtcttgatgaatttatcaaaaatcaattggccaaccattggtttggcagtagaagtggaagcagatacattttcgttggttgatttagaaccatccaatggtgagaaacccattggatttaaagcaaataaacttggctgatattcggacattttatttgtatttaatttattttcttgagcagacaaattggtaaacaaaactttagtaataataatgatttaattaatgatagtatagggaaatttttattggcgagtaaacctggataatttgacagaaaggtaaccgttacggaaacatcttgaataaaattctacgggtacatgatagcaattggtaacaaaacaaataactcttcaaaaaactgacagttttcaaaaaaagtaaaggactttaattaataagggaaaataaattttctctttcaataaatttaacacataattctcttaataattttctaataataatctactttaaaaacaaaatataatcggtttagcaagccatttttcaatgatctttaattttttaatacgatactgataataacttaataaactgaactaaaataaaatattttgttttgattgcgaagtagatgagtgagctgtgtggctggtgagttgtataattcgctagtgaaactgatgggcaaaaaaaatttgaatttaggggggagagtaacctgtgttgtgagtttttgttttgttttgttttgtatatctattatataagaagataagtactgtcaagaagtagaagattttaaaaggtaagacagcgagccgaaacttctttaaagaagactaaaatttcggaattggaaaaaaaggttggagtatttatcttccgtatttaaagtcggaaatttttcatctttttttttcaagatgtatgctcatgcactttattccccgaagatcttcgaaagcagttcaatttaattggctggagattggcgtttggagaggcggtgtgtatgtcaagaaaggcattgtcaacgcccggacaaataattctaatttttacaagatgccggtggtgttcggcattgtaaaaggtatgggtgctttgtgcgtccacgcatggggtatggggtatgggggcatcatcgattgttctccggtaacggaacacggcaatatttctgttctacagcttgaatacatgccgtggatctgtttatcaaagataatgtcatgtagcgtggcaagtcgacacagcaacgtgtggataatggatgagacgatagcgccactggttggttgtttgtaagcttcgattggtaacagtgggctaaaatagattgtagttatacccccacgtttgctgggtctcacgatccatatcagactgcccgcgtggggttaattctgaggtgttgagccagccaactcagacgttttgatgacgaagaacagaagatgcaagtcttctacgtatgcaatgatctgtccaactcaccgaaacaagaaaaaattttgcgtttttttttcctacaaatcccccatttattcggaaggtgtgggtggaggcgtagttttttgtttattttttcccaatttacgtagtcccgcaggtcggttttcctctcagtctccgtacatttcttattttttacgtttaaagttcgttaacgaggcaaaaaatggcctgtcttcctccttttccgccggcaactgtaactgtaaactgtaaaattgtaagtgtaattgtaattgtaactgtaattttaacgctgaattcttgcgcgctctcgttggttactatcttttcttcttaatcgaagtgtgtacagttatgtgccgtttgtttcaatttggctgaatcttcctcatcttgccccttctttggtgttttttttgcgcaactcaaaacctcgttactgcatcaaatttaaatttaagctagagagaaggtagtgagaaagctattttgtttatttgtattttttcgtttcccgatcgtttcccttccatttctgttttcgaacccttttattttctatctgtgaattagacagcctgttcaccggtagccttttgattgtttgtttgtcttttttaagattatcaatattatttaatatctcgcctcaactatcgacaatatagcctattttcttctcttttttggtccgcctctgttgtacgccatttctatactgtgttactaggataaaataaatacctgtactgcatcatctttcctatcaccatctttttccacaaaacaacatttcaactagacacaaggacaacgtaaatttctaaatggatatcgagcctactttcaaagggtacattgaagatgaagatgacgctttgcttattcttcaagcaactttggatggcaagttaaagcatataccaagaaggccttatgaaatagaaagaccttatttgatcgtatcaggtagtatattcgtttttattgaagagatatcgggcatcaagagatggactgatggcgtttcttggtctccatcaagaatatcaggcaagtttctaatatacaaggaactagacaaggaaaacgccgggtctaatgctaatgctacttcgagtggcagtactgattccgccgtcattacggatggaacttctggcgcgagaaataacccttcttcgtcgaaaatcaagctacctcctttgaagaatcaccagtttgatttgccacctactatgggccattcaagttttgagtcagagcaagacacctccatttctccatcaaaccgttcgaacttacctttaaagtatactggcctggtgaagaagacaatatctgtgaagctgaagagacctccattcaactcgattgaaaatttacatattgtctcttattattctgtaaaagatataaaacaaaattgtctagtgactcctaaagcttctccttttttgaaagatgttagaccttcacaggaactaattgtcgcgatgggaaatacaaccttaggcaacgtgaaaaacaattccactaccaccggtaatggtcctaataatataaacaataaaagcaactcttccactcccctgaatactgttatttccacgaataacaatagtgctaatataaatgctgctggcagtaatcaatttactagtgcaaacaaaaattattattataaaaatgatgaaagctctggatacccaatcactcaatttgctcccgcattaccatcaacaactttgatgtatacggcgaatccaccttatatcactcaatctcctgataacactaacgctactggtatgaatacacatgttaataataacaataataatagtaataacagtagtaatagtaataatagtaacaataataataataataataataataataataataacaataataataatattaataatattaataatgtcaatactaatgcagggaacggtaacaatccaaatagattccataacgcctcttttgcttataacaccaccggtgactttattaatccgcaacaacaaggacaaatttcttatccattttattatacaacaattccgataaacaatcctaactattataccacacaacctccaaaccctgtaacaaacgcttcaacgaacgagaatcaaggctattccacctcctcaactcaacacccttattatgggcatcctactgaaagtcaatcagcatcagcagccgcaggcgctactggcactcctggtacagccgagaatgtccttcccgtatccagtatgcagccactactccatcaagccaataataatagtgcaagctctgctacctctacagctccttatccggtgtattctatgaatgtgaatgttccttattacaattcttctgcttctgcatacaagagggcacaagaaaatactacttcaaatacgaatgcagaaccttctggtgctacaagcactaactcaggcaccatgctatcaaatcctgcatacgctaattctcagtacactccatcgcaagtgtattaccagggattcccccaatatgccatggcaagtgctcaaaatccgtctatgtatcaacaccagcaccaacatcctttgcccactgtatatccaatagcgacgcctcaacaaaatataatgagctctggtcacactttgagcactattggatctgatcctcaacatcatcactatcaacaagagcccaacgaccacaaaaacttcgctatgggtcacgcgaacaataatatcttaaacatcaccaataatgatacgatgaacaacctcaatacaaacacttcaactactacacaataagtaaatatattttaaaaaagtactccgattttcttttcttctccttgcctttttgagtatcgggtttactcatgaaaattatatcatttttcattttacagttttatatacttcgcttctttacgtaatcatgcctttaatttcatcttcatttgcctatggaaaaaagctattccttttgacatcataaaatatctttattaaagaatcccctctgtcaacattttctacgaaagatagcttagtgtattttttgaagatgctgtcgaaaatgattctcgacatactcgcgctggtggaaaaatgaagtggaaaagataagcaaattgatatataagcaaataaacatataatttggacgtacatcgaaattagttgttctcaacttattttcattgtttgatgaaaagcggaatatacatcacggctatataatgaataatggagacaataaaacgacattagaaaactcaaaaaatgcgtcactagctaatggaaattatgcgattcccacaaaactaaataggctgaaaaagaatgctgaccctagagttgctgcaatttcaggtgctttatctggtgcactatccgcaatgctggtctgtccttttgacgttgcgaaaacaagattacaagcacaaggtctccaaaacatgacacaccaaagtcaacattataaggggttttttggtacatttgctactattttcaaggatgaaggtgctgctgggctttataaaggtctacagccgacggttttaggttatattcctactttgatgatttacttttccgtctatgatttctgtagaaaatattcggtcgatattttcccacatagtccgtttctctcaaacgcttcttctgcaattactgcaggtgccatctctacagttgcgacaaatccgatttgggtagtaaaaacaagacttatgctgcaaacaggtatcggtaaatattccacccattataagggtaccatagacacatttagaaagatcattcaacaagagggtgctaaggctctttatgccggcttagtaccagccctgctggggatgctgaacgttgctatacagtttcctttatatgaaaatttaaaaataaggttcggatattcagaatcgactgacgtatcgacagatgtgacgagctcaaactttcaaaaattaatattggcctctatgctatctaaaatggtagcatctaccgtgacttatcctcacgaaatacttcgaactcgaatgcaactgaaatccgatcttccaaatactgttcaacgccatctccttccattgattaaaattacgtataggcaagagggcttcgccggcttttactctgggtttgcaactaatttggtaaggacagtacctgctgctgtggtaacactagtatcgtttgaatattctaaaaagtatttaactactttttttcaataaagtgaaacagaaaaatgtacatgacacaagctgagggtcgtaaaaagcatctttcgcaattgtttcaacctcatgacccctgtcttgactatgtattcctctttacgtcgggctactcgcaaaatcaagtagttttaaacctttagtatgttgcaaataaagagcaaaaaaagaatttattcatcccaggaatctcactacatttcgtaggggaagaaatgtagatttgaggttcatttggctcgtgagaacgacttgaaccttattcatactttatataatattttaggagtattgtagcattatgtatatttttcttgcgggtgtgcactgccgaaatagctgctgaatatccagattaaaaaactaaacaaaaaactgtttcttgttcgaatagtaaaagaaggttttcccaaatgctattgttatttagaaacgctggaaatacagtattttttgaagaactatccgttttacccgaacctattttaattcaattcttaagtactaattaaagtctgcttaatacatatagagtatatcttacataccattaacatgtaagttaaattttaagtcaaagatattgagttttttaaagaacatttggtgtatgtgaggccatctgcgctaatattttcaaaattagtttcaattgaagggccacttgttgtgttgaattttgggggtagtatttttttgcaactagatatgttatcgtcatgagtttgaagtggagctaaagaatcactctgtagctcgttctccccgtaaaaactatttatgctctctgctggtaattcatcgtgttctaaaagaggagagggcgaggcattttcgtgaatgctagcttcactagtagcgataatactcttcgggcaagatttatgcaggaaatcaaaaagaagtggataatgtgccacatttattgagtcatctttcaataattgtgccttcttcgggaggtttgcattcaatgcggtcaaattgttaacaatatctgaaacaatatcattgacacatgcgagttcttcatttaacgagccaatttttttttccgcattggccaatagacgatcatttccattgatacaattagtagaagccctttgctttaagacgtttttgtaactatgttctaccttttttaacgactttttaagttgaagttcaatttgctgcatctgattgcgttcctcgtcaatgtccctacttacaacttcatagatggacagaatgtctttttttacttgtaataactcatacttcgtgctattgaagatagcagcctgtgttaattttttatgggatgcaaggggaggtaagccctttaactcttcgtaataggaactgcttccaacggcatcaaattctattcttgatttccatttcagtatacctttagttaagtctgctaccatgctaggcactctctgcctttcttatggtttggttacgcatactcttcctttatatattcattgtcatattttaaggaagcaatcgctcccgacgcaaagtaaaaatattcagtgctttgcactccagttagaaaaaatgaagagaattcaattgagaataagcagggaagtaattggattgggagaatctaaaaaatgtggaactcactaaaagcattcgctctagtgttcggaggttgttgctccaatgttattacatttgaaaccttaatgagcaacgaaacaggcagcattaataatctcattactttttgtcaatttttatttgttacatgtcagggactccccgaatttctggatgttcatcaacctttcccttacttcaagcctctgaaaactccacttcacgtttatgtcattactgtcgttttattttatatttcatctacgacgaataataacgtatttaaatacaacatatccattccgattcatatcgttttcagatgcttcggaaccgtaataaccatgtttacatgctggttattaaatggtaggaaatatacaaagattcagattttatcaacactatttttaaccattggagctataattgcctcattattcaaagatgctgattttcggtaccaagatttgaaactgcaagcgtggaaaattggaagtgaccaatctgtagatctcacttttatttttggcatttgtatactagtactttcatcattcacatcatctttactttcagcatacaatgaacgtacgtatcaaaaatatggaaagcattggaaggagaatatcttttacagtcattttttatcattacctctctttctatttagtcgaaagcagttaattcacgaatatcgagtgatgagaaagtctgaaagaatattgtgttcaaattttggagggaagattctagtcccgcgagaagaaactctccttcttttcaatgtgttaacacaatatttttgcgtcaagggtgttaatatcctcgccagtaaaacaaacgctctgacactttccataacattacttgtaagaaaatttataagtcttttactgagcgtccgacttttcgataataacttgtcatatactggctacatcggggtctacctagtcttttttggtgcctttatatactcgctgggatcaattcaccccaggcaaaatgacaagggggcgataaagaaaagtaaatgaacacacattataaactaaccttaaatcctacttgtatgttccttaactctatattagtggtgttgacgtaagtttagataaaatcgcgaacgctgccgcctggaagtaaatgaaaaaaaaaaaaaaaagaattcatcacctaaactcactaatctttaaaactcattcatgagaagtggagaactatattacagctatggaacaaaggaacaacggtatgcaaaatttcgatctctgggttttaataaatgcatgtagccaattttatcttactaacaatctttgtgttttctctgtgtatagtctttcaagcaaaatataatgaatacaaacaaattttggaagaattgcaaacaaaaatcatagaattaggtcatgacaaagatgaacacactatagtcataaaaacactgaaagacgctgagccgacgagaaaatgttacaggatgataggtggcgcacttgttgaaagtgatgttcaaacgagtttgcctattcttgaaactaagaaggaaaacatagaaggtacaataagtaaaatgaaagaaaccttaatacaaactgcaaaagagtttgaaaaatggaaaaaagacaataagattcaagtcgttaaaaactaaaccatatataaaatctattgcagtacttagtttggcaaaaaatataaataaacacaatcaggtactcttatgtatttatgtgagccatttataaagaattataaaggatatgaaaacatatattagtttgtttttttgaatgtttcaagtttcttgccaacagaggaagtcgtaacgaaagaaacaacaaaaaatatccacgcaacaatgacgccacaaatggcgctaatataaacccaagaattgctgatttcccaacttcttgggtattcatcattagcaaggtgacggatagctttaacgtctttgtcagtagtgaacgacaggccaatcttacgatagtcagtgaggaatgtaaacactccatggcggtctggaaggatgaattcaccggtggtgtaatactgagtttcagaatcgtttccgcttggcgacaatgttagacggtagtacggatccacttgtcttagttcaaattggatatcatcagcgatatgtggtagccattcttctccattccattccgaaaagcctacagaataaataactttgtccttgattttgtagggctcttcgtcataactagtaccatccgcatgtgaatgaaccgcatgcacacttttgattacagatttttcattaaatgtccattttagtaattcttttgcaaactcctgattagagtcctgatttttgttctttaagaaatcactactgccgatccatactaaacgagcattgtttaagttctggaaaccaactacaagaaagccttgagatccgctggtccaagagttgcatttgcctttggactcagtaaaggatgttcttggagcgtttaaaattgggacgatttgttcacgattttctaataaagcagctgaactttccccaaaaacaaaatcctcgctttttctggcgttgtacacatatttgttcagaagatggttagaagaaaccactagctcttctgaggagggcgaaaaatagtcacgaataacgtgtccttttggacttggatagatacctaattcattcaaaaataaacgaatggtattcggaacagcacctggagaactcatgcataaaatgttaccttcattttcaaaaaatttaatcaactgcttaactgggatttgtctcgctaaattcttgcctcctttggtaggaaaaacgatgatgttatcaaacaatctttgctctttgtcatacaaatccacagtagtggaagtactgttaatatctaaatattcaagtttgtaattcctttgttctagatcttttaaatagactgagtactcctctaaaggttccgtagattggtcgtaaagaacaagcgttcttgaagtttgtgtgcccacaacgaaaatggcctgcagaaggatacaaaagaaaaaattccaatcggtccgcatcctaaataatcaaaaaaggataattcaaaatttgcaccgtcaattgtgttaaagtattcaactttataaccaattcagttgactatacacctctttaaaggtttctcttttcaagaagcgtgtttgatatttttcaggcgtagcttagggtaatgcattattcaataacccgccctgaaaatatcgaaagtagatattgggatatctttaattgtagtatactaatatgtatctataaaacaatgagagccccctatcatcatccagagatcttactccgccatttttattttttataggtttctggcaaccatgattcatcaacttttttgacagtggcactcttcttggaaggtctttgatttgttttagacttcatgtagtaataacttacacctccgatgatggctagaaagatgacctgaactgataaaaattgtgggttgaaaaaggaaataggtgggctaacaatttcgaatagggttggtggtgccgcaattctcacgatttcatcgaacctagaagctaataaaaatgggattaaaaagtattgtccttccggtaaatttaacgtaacgtcttgcccgaattttgaagttccgttgacctccatttcgtaaggcccaatactcgcacctgtaatgtccgccacaggataaccatgtggatatgtaacaattgttccgttgacaccaaaaattgtgatattagtatcttcccaattagtaacattataggctaaggtagcggtatcctccgcgtaaaactcaaggaaagaatcatgattttctgattccttcccaacgacatcatatttcacctctatattaatagaaggtggcgctaccgcctccgcaacttcctgttcatgttcgacattgtcgctattattagctgatatggcagcacagaagctgctcaaggcagttaataaattaaacccgattaacatagaaaacctcataattgccagctataaagaagtgacagtgaacttttacttgtttcttttgtttaaccactagtatgtaattgtttttgcagaatttgaaacttcaccaaaatcttcttaacgttcaatgacaaaattacttacccgaactaccgaactacgaaacatgaataaataaactggaggcataaactcatttccaaattcccggaatacatcgtgtagtcaagcagcatacatcactatcaaaaatcatgcgcttgtgattatcgtatagtgtatttatataatatatatagatagcgataaatggcaagatcctctatgataaaagtcatcataatgaaaacagatggcgcttgtctactgtttgcaaggcttgaaatcacaggtttttattatatcgtggatttttgccattgcctaaatcaaaaataatgatcgattttttgtgaattagggaacggaaggaaaaaatcagcaaacagtcagccctagcaccataggccgacagcaacaaaaactgtttttttattctcaaatattcatgatattgattacaccgtacttcttttcaatgcgtaaacaactagagttgacaaatattataaactaaaaactatcatattaataatatacctcctagcacttcgtaatgtttctgtcattgaatggcgagaacataattttaaagaatcaacaccttaaattgttaaccttaacaaatgaagtaaattcaaatatttactcttgaattctttttgctttaactaacacattgaaatatcaaattagtccacttttcttccttgttgaatgggtttcttcattaacaggggaacgcttgcctaccatcaagcccattcaatgcagatgtgattaattggtaaacaaagggccaagcaaaaatacatctctcctacatgctacataagtccgagatatgttttatttaagaactatgaatctgtaaatgactgattcaatattaaactaaaatttctatgaaacatcaaattaatcacgtgctttttaaaaaatataaatttaatttcattttctatttcaatatttattaaataaaaaatttgaaaaatatataaaaattgtagcagtattagatttccgaaaagaaaaaaaggtttcaagaaaaggaaaagaaaaactaaacgtagtataaagtcttgtttagtgcaagccactgttggcgtttcaactaaactattccttaaaaataaagtacaatgttactgctaaacaatgttgaaggtgagcttaagacagtaaatcaaggaaatgcggtataattcctgctgacaaagccgcacataaatagcagttgttagctataaggagatttttagctacgaacatggttgtaattctctttatcctgattaccttcaagattaagaaaaaaacaaccatggtaactactttggctcaaagtcaaacaaaacttttaccatttcacggtacacgtttccgataaaatatcactagctattcaatgtctgtattcatcgataagccagagtacgacgtacaaaaaataacgtaaatgcatatcctgcatcaagaaagaacccttatggacgaacaacgaaagagatctaaatttagaagacagcaagactaaccatttgatagcgtagtaaggcttatctagaaatgttggacagataggaagagaaagtataataatggtgtatggtagatgactctataatcgtggtcggaacgtgcaatatatgagaacgatgaatgcatatacatatgtcgcgactcctttttttccattatagcggcatcgctttatttcgcgttttaattcattttcttttttcttcatttctttctgcatatgcaaacgcggcaagaagtgcccacggatccgaagaaaacctaatacattgaagtttctctccctgagataggaactctctcttctgcgtcagaaaaaaaaaaaagtactctttctgcatatattgctcactactgactcactgatccttttacgaatagttgggcaacacctattaagttgtaaaacaatcgcgaaaaaaaaaagaaaacaaccaaggcatcccacttttcgaaccctggcgctcggaagacttaatcattgcgaggtctcaattggccggaccgccaccatgcagaaaaatggtggaaagtgcgtgcgcgtttctcgtgccacgtgcttttaacctaaataggatacaaactatcggcttatctttagacacgctctcgcagaacgatgagctactgacattttgagttgatattcaaccttttaaggtatctcagaatgaggctccggcgccaccgcaaagtctaccttttcttctttaagccttgagtttcttcttttgcgaaaacgttgcaatgtattaggcaagattatattaaggaggtattataaaaaggactcataagtgaaataaataatattcgtaatgctaaatgtcctggtcttgcttcgtactctcgaaaaacgtaatcttgcggtatttaacgctagtttaagaaagtgttactgtgtattaaatgttggcactccggagatttatattaaaccaaaggtctttgagatcgtgtaccataccgattctagtcggagccttgatcattattctcgtgctattccaactagttacccaccgaaatgatgcgcttatacgatcaagcaatgtaaacagtacaaacaagaaaacattgaaagatgcagatcctaaggttcttattgaagccttcggctctcctgaggtcgacccagtggatacaattccagtatcgccactagaattagttccattttatgaccagtctatagatactaaaaggagttctagttggctaatcaataagaagggctattataagcatttcaacgaattaagcttaactgatagatgtaaattttatttccggacactgtatacgctagacgatgaatggactaatagtgtgaagaaactggagtacagcataaatgataatgaaggagttgacgaaggtaaagatgcgaatggaaatccaatggatgagaaatccgagagattgtatcgccggaaatatgatatgttccaggcatttgagagaataagagcctatgatagatgttttatgcaggccaatccagttaatattcaagaaatttttccgaaaagtgataagatgtcgaaagagagggttcaatcaaaattaatcaaaaccttaaatgctactttccctaattatgatccagacaattttaagaaatacgatcaattcgaattcgagcacaaaatgtttccgtttataaataactttaccacagagacttttcatgagatggttccaaaaatcacatcaccttttggaaaagtattagagcaaggcttcttacccaagttcgatcataaaactggtaaagtgcaggagtatttcaaatatgaatacgatccatcaaaaaccttctgggccaattggagggatatgagcgccaaagtagccggtcgtggtattgtattgagtttaggttccaaccaatttccattagctgtcaaatttattgcttctttgagatttgaagggaatactttaccgatccaagtggtctatagaggcgatgagctgtcgcaagaactagtggacaaacttatatatgctgctagaagtcctgatttcaaaccagtagaaaataattacgataattctaccaatgttccacaagaaatttggttcctagatgtttctaataccatccaccctaagtggcgaggtgacttcggtagttataaaagtaaatggctagtggttctactcaatcttttgcaagaatttgtctttttagatattgatgctattagttatgaaaaaattgataactacttcaagaccactgaataccagaagacaggaactgtattttacagggaaagggcgctaagagaaaacgtgaatgaaagatgtattgctagatatgaaactctattgcctagaaaccttgaatctaaaaatttccaaaactcacttcttatcgatcctgatcatgctctcaacgaatgtgacaatactttaactacagaagagtacatattcaaagctttttttcatcatagaaggcagcaccagttagaagctggtttatttgctgtcgacaaatcaaaacacacgatccccctagtgcttgctgctatgattcatttggccaaaaatacagcccactgcacacatggtgataaagagaatttctggttagggttcttggccgcaggtcacacttatgcactgcagggagtgtattccggagctattggtgattatgtaaagaaaaccgacttgaacggaaagaggcaagaagctgcagtcgaaatatgttccgggcaaatagcacatatgtctactgataagaaaactttactttgggttaacggtggaggtaccttttgtaaacacgataatgctgctaaagatgattggaaaaaagatggcgactttaagaaattcaaagatcaattcaagacttttgaagaaatggaaaaatattattacataactccaatcagcagcaaatatgtcatcttacctgatccaaaatctgatgattggcatagggcctctgcaggtgcttgtggtggttatatatggtgtgccacacataaaaccctcctaaagccatatagttataaccacagaaccactcacggcgaattaataactctagatgaggagcagcgcctacatattgatgctgtcaacactgtttggtcacatgctaataaagataacaccagatcattcactgaagaagagatcaaggaattagaaaattctagacacgaacaaagctagaatgcattaaccagtgttttttctaactgtttatggtactagcctttgtgaacatgtatagtaaagcatatcggacgtagttttttaagaaccttgtttattacactttgacggttaggagttttattggaattacctcactttgcacataaacctctagaaaagaaggtaatacacaatgctttcgatcgatttgataaataatagtaattcatattggcataatgctacatatacgtatatatattttttttactcttttaataatcaaattaacttaataattgttgagaatctggtgaaggttttctttttcttttattttttattcttttttttcaggcaagttttatatttctcttattcagaaagtctacgtcaaagagtcattgaaagcttttatcttagataaaactattgggcttccaacagcataaaaaggccgcttaagtacctgtgataataggtactaattataatcgtaatgtttacctgatattactttctagtgtaaataactgtgcagtaatcttttgggtaatttcttttcatatttaactagtgcacatactcgcattatgaccattgtatgcgttcaatactaagggacaataaaacaagcattatactatatgttgtattgcttccaatgattgaaaaagcaacagttaccgctacaaagggtactatttactcaaatctataaaagaaaccaagccatatatttgagataagcggcttgattagctctactttatattcaatagcgtgctgggtaaaattctatttgttattttattggtttaaacgttacccgaacagaacacttttatgtaaatttttttttatcgacactttttttcagaatggaataaaaagaaaaataggcgatgagataaatttataacagtcgtcaattctcaaaaaagcagagttcaagatattgagtttaatatcaaactgcaaatacactaagtaaaaaaagttgcatacaatgacatccgttagaaaaagaaagatgaacagatcttctgttgggaaagcaaccaggagaaacaaagacaaacaaagaaagattaacatccagtctaatccgattattgcagcaaattgggactattcactgacaatggcacaaaactataagaaattagggctaagggctaaattacaaacaccagcaggaggcaaagaggccgatttaagtaaagtagttaaaagaattccattaacgaagcctgtgttggatgaagatgaagatgaagatgaaggtgaggacgagcaaaatgattataatgcggctaccgtggagctcgatgaaaatgagataccagaaggtggggcaaggatacagcgtgataagaatggtgatgttgtaagagttgtttacggtaagaaaaagaactttgatgctgatgaggatgttaacgaaataaaagctagggatactaccgaggagaccgaagtggttaagaaattagaagaacttgcgtctagaccagttatcagaaaggaacgtagccaaagtgaaagggaagaagaatggttggaaaaattatataagaaacacggtgatgattataaaaaaatgtttttcgataagaagctgaacatctaccagcaatctgagggtgacttgaaaagaaggttattaaggtggaaaaaaagaaacggtattgcatcaaaataaaccaatggcaactaccaattgattaccacgtaatatttatatatgtatctatatatgtttttatgcatcaatatcaagtgttttagagaacagcaaattatgtttgatatttccattccactatattatagaacgtgagaagcaaatagaaaactgtgaaataaagtagacttcaaataaataagtataatattttctctattatagatataagaaaattaagaaatagaaagaaagctaatttggttccacaaaggctctataggtagtaaacgcctcatcttcagcttccaaatcaacaggcaaatgtggagcgatgaaaaagacaaaaccgggttcagctttcaatttttggccatctgctttaatgtaaccattaccttttgtagtgattaagatacttggaccatcaacaccttcaaaatgcctttgaccaagtttctcatcaaaagtagtctccaatacagcaaattcttcgattggagggttatataaaactgacttaccgttaccagaggacctgtcgaactttaaaggctgcattttttgcttttccacaggatcatatgtataggttaacatggagaccaagtttttaacatccttgaattttggagtgaagcctgctctaactacgttgtcagaagcagccatacattccataatatcaccgcttatataggcgtgaggatccttagctcttaaaaagatggcttcaccagcattcaatctgcagtgattcaacaataaacatccacaaaacaaacccacgtcatcagggaactgtttattcagtctttgaattaattctggtaaatcaggtttgttaaagtctgatggagaattctttgatctttcgaccaaggagcgagcttgaatcttgattttgtcatccgaagcgttcatgaccctgctgaaaacagcttgcaatagctttttgttttgctcatcttctggggaacctttctgagcagaaggttgaatgttctcaataaaattcctggaagtttcttcaccaacaatgttgcgtaattcaggaatacgtttcaattcatctgcaatctcttgcaaaggtttgaacccgcagaaaccttcaaagtcagtcacagcgatggccatttcaggtttgtgattatcatcaggatagttcttaggatcttgagcgtgcaatattttacccaaggctttgtcgggatgtgcttgaatagacaagactttttcaatggacaaaactttgaaaaggaagggcaattcatttgtggcgtggaacttatcaataatgtccttacctaacatggcagaggggttcttggagatgatatctctcagggattccttagactcatggttgtaggaaggcatcttgctgtgggtacccatccataactctgcatatggtttatcttgttcaatttgaacagaggggtcagaatgggcagcaaattgagcgacagctgaagaagagccgattttaccccagtcgtattgttggtagcctacatagagtcgtacgcgttagttagtgtaccaaaaaaaaaaaaaaaaaatactcaaagtattcaaaatatttgacgaaaaatggcacatacctgcatctaacctgaacagcttgttggacatgttttaaaattttctggtctgatgttctttacgtgtttagtgttgaatgattacaagaaacaaacattttatacagaaatatactaagattgcgacgtgtatatttaaatacgtaaatcgcggcgaaaaaggacacggacgcgacaaaaaattgctacaataaccaagcagcacgaaatggatagtgcaccacgagacttggcatgatcaaagtgcaaaagaaagcagaataacaaattactcccgcaaagtactagctatatcagggaacgactttattggcatcttgttgtagcaaggttttcatgattctcatccttgcgcttgtcgcgcggcacgatgccagtgcggagtttccgcgatatgatgtaactgcagctgttggtggcgaactttgcataagatcgacctcctactgatgagaaagataggatggattatatagaagagcacaagcaacgatgaatgggttggtattaggcgctacaggtttatgcggaggcgggtttctgaggcacgcacaggaggcaccccagttctctaaggtatacgcgatcttgagaagggaattgccctttccggccactgataaagttgtggccatagtagaaagggataattcaaagtggtcacaattgatcaccaatgaaatgaatccgcaggtgctattcaccgcactggcaacgacaagggcagctgcaggcggtttggacaagcaatacaagatcgatcatgatttaaacttacaattggcccaggctgccaaggaaaaaggatgtgaaacgatcgttctcgtttcttccgctggtgctcatccggactccaggttcggctacatgaagatgaagggcgagattgaacgcgatgttatcgctcttgattttaagcacattataattttgcgcccaggccctctccttggtgaacggacaaattctaaacaaagcggatttggcggcaatctgactgctgctttgggcactcgcgtgtaccgttctagattccagaggttgctaggctatccagtttatggcgatgaggtaggaaaagttggtgttcatttggcgttgaatacttctgggaaagacaaggttcagtttgtctccagcaaggacattcttgacatctcagcttctctggagaagattgctacctaaatcaaccaacggcttcttctcgcagctacagttgtattttactgtgacgtacttttgcgcgcgtacgggttcaatgaattacggattttcaacaacttcacacaatcatagctttttttactttttcgcctcattattttctttaaagaaacgatgataaacagagatttatcgtcatgttatttcgttcgtatatatcgtatttgcgttttagctgtataaagtaaaatactatatctaacgtggctttttttatttccccgtctgccctcttatgctcatagaaaacactaatgatcggtttggtatcgtcatagatgcagggtcttcgggttcgagaatccatgtgtttaagtggcaggacacggaatcgcttcttcatgcaacaaaccaggactcacagtccatattacaatcagtacctcatattcatcaagaaaaagactggacttttaagctgaatccaggcttgtcgagttttgaaaaaaaacctcaagatgcgtacaaatctcacatcaagccgttactagattttgctaagaatattatccctgaatcacattggtcgagttgtcccgtttttattcaagcaaccgcgggcatgcgccttttacctcaagacatacaatcttccattttggatggtttgtgtcaggggctcaaacaccctgcagaatttttggttgaggattgctcagcacaaattcaagtcattgatggtgaaaccgaaggtttatatggctggcttggcttaaactatctatatggacactttaatgactataatccagaggtctctgaccattttacatttgggtttatggacatgggcggtgcctctactcagattgcgtttgcaccgcatgattcaggagaaatagctagacatagagatgacatcgccaccatcttcttgaggagtgttaacggagatttgcagaaatgggacgtttttgttagtacgtggttagggtttggtgccaatcaggctagaagaaggtacttggctcagttgatcaatacccttccagaaaacacaaatgattacgaaaatgatgacttctctacaaggaacttgaatgatccatgtatgccgcgaggaagcagcacggattttgaatttaaagataccatatttcacatcgcgggttctgggaattacgaacaatgtacaaaatctatttatccgttacttttaaagaacatgccttgtgatgacgagccgtgcttgtttaatggtgttcatgctcctcgaatagactttgccaatgacaaatttataggtacttctgagtactggtacactgccaacgacgtattcaaacttgggggcgaatacaactttgacaaatttagcaaaagcctaagggagttttgcaattccaattggacgcaaatattagcgaacagtgataaaggcgtgtataattctattccggagaattttttgaaagatgcatgctttaagggcaattgggtccttaatatacttcatgaagggtttgatatgcctcgaatagatgtcgacgcagaaaatgtcaatgacaggcccttatttcaaagtgtggaaaaagtcgaagaacgagagttatcgtggacactaggcagaattttactttatgcctcaggtagcatattggcaggtaatgatgacttcatggtgggtattgcgcccagtgaaagaagaactaagctcactggtaagaaattcatacctggcaagttactggagtctgatcaactacgcaagcaaagttccagcctttctaataaaggatttttgatgtggttcgcaattatttgttgcatattttacttgatctttcataggtcacacataatcagaagacgtttttccggtctgtacaacattaccaaggactttaagacaggcataaggagaaggttgaaatttctaaggagatcagatccattttccagattggaggaaggtgaacttggaacagacgtagatggcttcaaagatgtgtacaggatgaagagtagcagtatgtttgatcttggtaagagttcagccacaatgcaaagggagcacgaaccacaaaggacagcaagtcagtccgctaatctcgctccgtcaaacttacgacctgcgttttctatggctgatttttccaaatttaaggacagtaggctatatgattgaatgtggtggtgtatgtgccataaatagaagcgcatatacttctcacataaatatatgtatatatctagtgaggtgccatagtattgcattaacagtgattcacgtcactctaaacgtcgcttctgttttttttttgaaatttttttctcacagctgctgaaaattttcgagcgaggcgatgagatgagctaattatatcaagagggaattgtactagtaatactttggtacacacaagaacaagcatataggtatacagtcacgactataatatcataaaatgagagtcagaaagcgccaatctagaagaacatctaccaagttgaaggaaggtattaagaagaaggcttctgcccatagaaaaaaggaaaagaagatggctaagaaggacgttacttggagatcaaggtctaagaaagaccctggtattccttctaactttccttataaggctaagatcttagaagaaatagaagccaaaaaaatgaaggacttagaggaaagagagcttgccaaacaacaacgattggaggctaggaaagctgccaaggaacaaggcgttgatgcaatggatgaagacatgatagaagacgatgaaaatggattagcagctttggttgagtctgctcagcaagcagctgctgaatatgagggcacaccctctaatgatgcagatgttcgtgatgatgaattggacgtcattgattataacattgatttctacggtgaagatgtagaaggcgagtcagaacttgaaaaatctaggaaagcttatgacaagattttcaaatccgttattgatgcttctgatgtcatcctatatgttttggatgccagagatccagagagtacaagatcaagaaaggtggaagaagccgtcttacaaagtcagggtaaaaggctgattttaatactgaacaaagttgatttaattcccccacatgtattggaacaatggttaaattacttaaagtctagttttcctacaatcccattaagagcttcttctggtgcagtcaacggaacttctttcaacagaaagctaagccaaaccactactgcaagtgcactgctagagtcgctgaaaacttactctaataacagcaatttgaagagatctattgtagtgggtgttatcggttatccaaatgttggtaaatcatctgttatcaacgctcttttggcgcgccgtggaggtcaatcaaaggcttgcccagtcggtaatgaagcaggtgttactacctctctgagagagatcaaaatcgacaacaagttgaagattctagattctcctggtatatgtttcccaagcgaaaataagaaaagatcgaaagttgaacatgaagctgaattagctcttctaaatgctctaccggcaaaacacattgttgatccgtatccagctgtcttaatgttggtaaagagactagctaaatcagatgaaatgacagagagctttaaaaagctgtatgaaattcctcctattcctgctaatgatgcagatacgtttacaaaacatttcttaattcacgtcgctcgtaaaagaggtagattagggaaaggcggtattccaaatcttgccagtgctggtctttcggtacttaatgactggagggatggtaaaattcttggttgggttttaccaaatacatcggcagctgcatctcaacaagataaacaaaatctaagtactataaacactggcactaaacaagctccaattgcagcaaatgaatccaccattgtatccgagtggtccaaagaatttgatttggatggattatttagctctcttgacaaggccatagatgctagcaaagatcaagatacaatgatggaataaataagtcatatgtaaggctatttttatgtaaggggtgtttcttattttttctttatcatcaaataacattactgtaaattataggtgtgcttttaaactcattactatacatcttattttttttagttttactgcctttttgctctttggacaaagaaatcattaaaaagttccaacttttattatgtttcatatataagatatacaaaatataaaatgcaaaacgaatttcagagatagcatgacttatgaaattggggacagactcaagattggtggatatttttgcaccatcaaattcataggtgttattaagccgtggccttcggtaaaagcttatggggtggaatgggacgatcacagccggggaaaacattctggaacaatagatgacatacactattttgacgttcaaattcctaattcaggatcatttttgaaggagtctaagattaaatctccaggtgtacgcagaattacgttttacgaagcattgtcagaaaagtatggaggctcgagtaataacattaatgacctatctataggtaacaaaagggttgagggtttgggattcgatgaactaaatgcgagaaataagaattataagaagttaagaaaaatagctttgcgagattccgatgtcgctatattgtttcaaaatcaagatgagttaaaccgtgtaatacaaaattgtgtgaacgtcaaggaccttgatttatcgcttaatctattcacgaatatcaactctttatgtgagttcatagaacctttgaagaacttggagagccttaatatatctcaaaataaacttttaagcggttgggacaacttgaaagaatatgacctatcacacatcaaaactttacgtctgtcttcctgtggtttaagttataaacatattggtaagctgctcaaaagcttcaggacactgaaaatgttggatttaagctataacaacttgaccagtgcgggaatccaaaattttgagaatgaaataccgtgtactttggaggaactgaatattagcggaaataatcttatatcgtttccattgtttccaaaaaatttgacattgaaaggtttaaatgtctccaataatcaaatttctagagcaccaagtattgctatttattctgttgaatccttggatataacagataacaaatttaaggaaagaagtttgatagatgatttgaataagacatttccctctttgaaaaatatccatctgagtggcaacgaattcaactacaacggaaattatattaacgtcgaagaacaggctactttttatgaagtactggctaggtttgatcgtgtgatggtattgaatggatcaatatgtgatgtaaaaacaagaagagaggctgagatgttttttgtttccaaggtaatgaataacgaattgagctatgacaccaatctgccgcgttggtcaagcctcataaagtcgtatgaaatcgatatgagtaagctaagtttcaacaatgaaagagaaacacggcaatctcttgtcttaaaaataaagataagagctggcaagaagccgagtagtgatttagattattgggtccttcccagttttacagtaaggtacgttaagagtgtaatatgtcgaaagctaaactttgacatactgaatgttaagttatttcatgaaaattctgaagggatgataaacgaaataaagtataattttcgccccatttcagattttaatgttgtgaacggagatattattcatgtttcgtctccagtaaataacaagagcattcagaaggttaacagcccatcgtaatcacagtatatagttaatcttggctagttgcatatttaaaaatcaggaaacagccttttagattgtaagcggatgttattctaattttttcttagtttctttattttattatgtagcagatggatagtaatatagtgttgacggctccgtttgttactcaacgctgaagttccataaggggtcgcccaaatggtgaatcaattctatggaatgacctttgttcactgatttaatttcttcagtacccatcatcaattcaccaatagccaatgcattctctttattttcggcattgatgactacaatcgtacctttctcgtaaccaggagcaggtggtaagtcggcacccgcagaagttaggccagggcacatgatattagcacctgagagaacgaatttaatagcacctctatcaacctgaacagtgggataagcctctggaaatttgtgtactaatttcaggcttggaatcagttcatcgaatttttgaaaaaaaagaacttcaccatcgacggaatacaattggatcttatcttcacatttaatcaactcgatttgactcttcttaggaattaattcatcaataacatcttctattttggggtactgcttgaccaatttggcctttaacgttctttgaattgaagatttgacctttgaacgtgaatggacatcttctcttgtgaatctatcgatgatgatgttagtaattgcttactgagtcaaaagtgtacactaacccctggtaaaaccagtgaattacgcaatattcattctcatgttagacatacttcttaaacatttcctctctgctgttttagtttaccgtctttgtcttttatatggttttacataaggttatagcaaaatcaagttttttcacacaataatttttcagataattaaatttttcgtcatttttacacctacaaatacaaagcataagagtaaggtaactatgaatttagtggaaaatgaccataatgataattatcaatagataaaattatggtttttgaggtgaagttgaggtctcgtttatagacggcactgtcaggtaattggtcaactctcctatacaaagtttactgtatcgggtgaaaagaaagacacacaagaaggagaacactcatgcctaccattttagttgccatttctgtattacttacaattccagcttctataacgtgaactcacattagagaattcggtgaaaaagaaaagaaaaatatggttgggccctcaattgaatgtttcagtccggtatccctaacctattttttgatattacttccaaagaaaaataaacagtccctttgaaagaatgaatatcggtaatgaaaaaaggtattccaaaaattccctacatagtcttgaagtattcaaaagcgaacaccgaattgaccatgaggagacggtctggtttataattaaatttcaaccagcaaaaacacaatctcggacgaatcctcactgatatgcgtatttcccgtgcataaggatggagtattaaggaaggaagtgaaagaaaagaaaatgcattaaacgtaagtaacaatagtaattggacaatgaagctaactaatattctgttccttttatattcagaaaaaaaaattcgaaaactaatatatcattttacacgatatttgaaattgaaatttatcaaaatatttacttaattagtctaaatatgtaatatgaagcgacaatgcagaggttacttaggcattcttgtattcctcgaacgcacttatgatatcgttcttcgtgaagcgtatgtttgtccctctatagtgtttatcaattacagtgtatagtttcaagtatagtgagacggtttgaccttgaatgcacgaccacaacttatcgcataggacgttgtttatggcattttcttggtggtaaccgaagtcatttaccatatgagtgtgcagcctttttactagagtttcaatttcatgggaagtgtatgctaaaagaatgttctctaggttctgcctgctatatgcggcccatcttgaaggattggtcatgttcacattgttggtattttcaatgatgttgctcacaccataaacaaaggctgttagtttaggcatagtatcgcggagtagaaaggaagcataagattctttttccacatcgaaaactttcttaacgttttgcaatgacgtatcaaatataccatccttattgaagtttaacatggaaagcatttcagttagccagttactgttcactaggagagaaatagtttccatatagtcattatttaaagcagcagtatctgaaaggtttggattaatgcttgaattaacttctttgtgagttatcgatcgtgtggcagctatgcttagcttcctgaagctcgaattcattaattcgatggactcgtagccttcatcggtatctttaatatccatagacctcttagcaaattggaacaaatcttctgaattcttcaagcctactggtaaatcaagtatacctggaagaatttctccattggtggttgcgttagaaattctttcgaagtgcaaaacctgctcttctacattatcagaccacacttgttttatttgtgtgtacattctagtcactgcagacaataaaaattcatggttggatgattctaagcttttaatttcattctccaagtaaaaagttaaggctggggctaccgttggttcggctttcactaattctacaaaatatgaggacagcctagtgacaataggttggaatattcttgagaccaactgggtttcaataacggctgcttctctatcagattgcattactttcacagtatctaataatattggaggagcatctggatcattgaaatgtttaatgtattcttcgaaattatgctttgaagatatatgaaagaacacttcgacaaaattttgataaacaatacattcttgcctcatggtttgaaggcactcggtaagaagagaaaaactattcttgaaaaccgggttgatatcatttgtttttctctcttttctaaatgtgtcccattcatttagtaactggcttaagctcagctcattcattttttcatcatttgtgtcaatgccttgtaattgtgatattttcttagtccataactccatgtatactggttgaatactgacgttccaattttccacaattgcttgatacgatttttgtgaaatttctttacagaacagtattaaaggagaaaatatcaataaagtcgtcaaaattctaatcatttgatcgtgtgagatatcttgtccacgtatatttgagaatttcttctgcatttcctccacaattctgttaagaaatatcttggtaactttctcataaaactgtagcctctgctttagtccggaaatttctcttagattatattctacttcatttccatcgctgcctattgcttgaaatgcttttaataataaattcaattggttttccatccatggcaagttcttctctcttattggacattctaataactgatttagggaaatttcatcaagagatacagttttcaaaagttcatcaagtgtgttccatagaagtttcttgttagcactttcaacttgtaatccgttatcttggctctctacgttttcgatatcattagaaaaattgctcatttccatcaagaataaagagagagtggggattatgcgatgacattcgtcattgaccttgtcttcgtaggggcggatattaggcccaattttttgcaaagataataaattttggttgaataagtattccgtttccgccaatcttaagtcaatcctttcaatcatactatcagcatcgtcttcaatggaccaattgatatctgttaatatttctaataaaacctcatcgtcaatattttccatcgtttttatctcctctttagattcaatcagcgcttcagattcgttattctcttccggaaggattaatttctgcgaaacggcaggtgcttcttcttgaataattgacacttcatggtacacgtgaggagcttcaccttcaaaattattgctatacctaacctcatctcccttctcgaacgaaagatcgttcttctcatcttggtcctctcctgataagttagatgtattcaaacctgctatctcgtcactcaaactgatcgagtcattcaaatcgcttccaccgagtgactcaactttggcaatatttagtggtttttttaattggtcatgagctctagctgtacttctctcgggcacgtaagtaccattttgcatagtaggggtggtttctgtttcttccgccaaaactgcgtttaagtcctccaaaaggttatcaaccttaccatttatttcttgagtataactttcattgtctactttgtttcttttacttttttcttcctcctcctttttagcaagcgcttcttgctcttctttttttaatctctcagctgtttcttgttctctttgttttctctgtatttccaatagttctctctctttttttaggcgttgctcttcttcgaattgccgttgacgtttcaactccatttgctttttagcctccagttccatttgacgttttcgttcctcttcttcgagttgtcgttggtgttccaattccatttgccttttcctctcctcctgctttattcttctttcctcttctaatcttttcatctcattttccttttgtaactgaagtcttttttgctcttctaatcgtctcagttcagcctcttcttgttgctgttgttgctctaactcgtatcttttattcacttcattcaatgtcgaattggaagaatagggggccttatttagagatttcattcctgcatgatattccacgcttgcaggcgttgacactggattaacgctttctgtttcagaccttcttgtcctctcagtaggtgctgaaaaggggacagagcccaccgattgggtagtgtttgtcgtgaaattacttgtaggtgactttattggagatacggaaccggggcgatttgtgatgactgctctttgataactcctctcgtcaagataaaaaagggataaatcccaattgaccaattcagggacatgaccttcgaatgtttgaatgtatagagtaattagagatttaatgaaaacagttctttccttcgcagaattcgtttcccagtagtattttttactcatggtaagaatgaagccttcagatatctccaggtccttctctactcttactagttcggtcaactgccaagttctaccaatttgaaaagagccgtctgagttttctcttgctttatgaatttgtattagcttggcattgttgggcttggcactcaaaataaggagtcttttctttttgttctccaattttgaatctggaggaggtcttgaactagggaattttgaatcttctataatccggacatgtgtaatataattattcggcggttcacctgtcttatggtcgggtctggaaaagcagcaattaattatggctttcctatccctttcatattgttcggctaaaaaattcgaagtttgagaggaatttgaagctctcgacacgtttctcttatgcgaataatttccaccagaaacaggtggtgcggaagagggtactgcaccttgactgacgtttctagaatggtgagcactgctaccggatattgttctcttgtggaaaaacgatgtgttttcatcgtgtgatgtctcacgactgtgagacttccttttaaaaggagacttcgaggacctcataatatagaataaattgcgtagccttgttacctagctggagatatctggcaccgactcagtctttatgaccgctttttcttcataagctatgatactgttattgctataagtgttcaccaagttagtatttgcccattaataccgggtgacatagtcccacaagcgtggttctcaaaaagcaacgaaaaattttctgacttggcaaggtgagacttaggctgataagtaagtactttttagtttttagtgtacaataccccctaaggaacccaggttttaatactattatctttataatgtctctcgactttaacactttggcccaaaacttcacccagttttactataatcaatttgataccgatagaagccaattgggtaacttgtacagaaatgaatctatgctaacattcgagactagtcaattgcaaggtgcaaaggacattgttgagaaattagtatctttgccatttcaaaaggtccaacatcgtatcactactttggatgcgcaacctgcttccccaaatggcgatgtcttagtcatgatcactggtgatctgttgattgacgaagaacaaaatccacagcgtttctctcaagtgttccatttgattcctgatggaaactcttactacgtgtttaacgatatcttccgtttgaattactctgcttaaggattttttaagtcaccacagaaacatgtattttcattttcgaatattgtttagcataattgaagatgcttagctaacgatgtataaggcgatagcgataaagaagatatatatatatatatatgtatgaagatagcgtttttaaatgtatttctttaatactgatcttcgatcattttgagcttgtttggcgggaataccattcttaatatcttcagagacaagtaaatccacttcaattgacttttcgatataggtaactaattttgaaatgtcagtctcttgaacaggaatgcgtactattccattattgtcacctgcaatataatcaccaggacatattgtttgggttacgccatcactcgttaagattttcaactgtacgttagtgcctacggctttaacgacagcctttggagcgcaagatccaacaccgtaagcaaaaacgggatggtttaaagtccggtgttcatccacatctcttatgcgtccaaagactactgtcccattcgatttcaaatattgtgctctggtactcatcagccccccgtacatcgcttgcgtaattttaataaatgggtggaactgactttgcaaatggggctccagtgcgaggacgagtattgagttgggagggacagagtctatatagttcacggcaggtcttggatcatcaatgggtgcaaacagtactgtgtatgcagtgcctactatggagctattttgcggtggagaaattgctgttagattagggaaataaccacccgttggaatgttataaacattcaacaatccgtccgaaatatcacaggttgagaacctctgtaacttttgaagatctgacattgcggacggcggtttctacttatactgttaatttttttaaaagttggtttagtttatggaaagccatacagttcaagttttttcgcgctaagtaaggtgatcacttttttttatcgttcttatcacttccagctgtaatacatcatagagattaatgaatgagcaacgtttgactcacatacagacctaagtggcggaaattattattggcaaaatagctgggcttgcagttttcctgattatttgggtaagctgatggtattctccaaacgcggtgggcaagatctcagattatctgctccttatcgactgctttttatttctataaatgagcttgtatacacatgtatagtttgtatttggattatttatacttttacggattatgttcgtattgtttgtatttcattccctaattttcctttacagatataatttcatgattaaatttcaaggcaaaatataaaattattcagaaatagcttcatcacacagtgtctagcgaaaatatttgttaaaatgcttaacccaaagtgtcattctcgacagtgaacctttcctaaaaacttacaattgttattacaaagttcttcgggggataacagtcatggagttacagcaatgataccttatgcggctaagttttctttatttgcacataaagggtgccttcaacattactagactgcgtggtgttgttcaattcaaactggagacatagactacgaaaatcttttagtcaaatttacaagggcgagtagcttttaattgtgccttcatgtgccaagtaaattgcgtacaaaaagtgtcaagagattttctcattccctacatttgccagttctataggcaccttcttgcgcatatacatatctacaaatatcccggcttatttccagtattactatgttttactcttaattcaaataagcactgctattattacttttgatcacgtcaaaagatacaaaagacaatctacaagtttatggccttgcattgtttataatttatgtgctatctgagcatacccgccttttctctattgttattcgagagaagactaaaaatatctgctgcaagaacaaaaatgggaactgcttgtctcttaaaattatcaatccacaatggaaatagactttttttacacagcaacggtttttgaatgctatgaaacggtcattatcagctaacacgctcaacactttactccatcttcttaaagggtgtaaacagaacgataaatgatttccataaatagtaaggcccagccgacagcctgcagcgcaaaagtgaaccgtttccatctaacttggataatctgcattgttcccaacgaatgacagaatccatcgccagatctaataaggttcaattttctctatacgacggctataaaaggaagttttccgagcgcgcttcgaagcagaatagggaggaccccagacccgttttagtgcctgtccctttttagtacgtgtttccgtttccgtgcctggctagatccatctttcttcgcgcgtttattttcagcaccatgttttaggtttttacagcatcgtttaaggaacccaacaatacaatagcgggaagaatgcactttctcgttccataaagggtctctttcacctatacggttggtacagatttccagtgtatgccagtcagccacggcattacgtcgtttgcttctattttcttcgttttgaactgcgtttgtatgcaactgtcccttgacagagaaaaaagtgaagcaaaatgacagacaaagaaatcttttgtataaaaggtcggttgaatcttgttgttagcttgaaatcagcttgcttttctcctctaaattacataaaaaaccaagaaaatatcagactttttcattcgctttcaacaagtactacaataattaaaaatggcttacactaagatcgctttattcgctgctattgctgctttggcttccgctcaaacccaagatcaaattaacgaattgaacgttattttgaacgatgtcaaatctcacttgcaagagtacattagcttagcttctgattcttcctctggattttccttaagcagtatgccagctggtgttttggatatcggtatggctttagcttccgccactgacgactcctacactactttgtactctgaggttgactttgctggtgttagcaagatgttgaccatggttccatggtactcctctagattggaaccagctttgaagtctttgaatggtgatgcttcttcttctgctgccccaagctcttctgctgctccaacttcttctgctgccccaagctcatctgctgccccaacttcttctgctgcctcaagctcttctgaagctaagtcttcttctgctgccccaagctcttctgaagctaagtcttcttctgctgccccaagctcttctgaagctaagtcttcttctgctgccccaagctcttctgaagctaagtcttcttctgctgctccaagctccactgaagctaagataacttctgctgctccaagctccactggtgccaagacctctgccatctctcaaattaccgatggtcaaatccaagctaccaaggctgtttctgagcaaactgaaaacggtgctgctaaggcctttgttggtatgggtgctggtgttgtcgcagctgccgctatgttgttataagttattggtttttaataataactacgtaaaaaataaccatagtcatacccttttttattaactactttcggtcctttcttctgctttacaattaatgtaaatatgtttcggttctttaattgcatatataacaagattaatttttcttttttttaattcattttgtcttctatagtttttcctgtgccatattttaaatgttccagcggtgttggcactactgtctgttggatacttgtataagatatcaatttattaacttattgcaagaaattattttgtgcagtgtgaagacttaaagtgtattgaaagaccattgaggaagacctgaacattaaccgaattcaacgaaggctgaaatgctaggattgataacgtaacagaactaattagaatgtgtagacatgacacatgctgattgaaacatcatgtcaaatcatcatcttcctttgatgcttttttagcagcttcgaaaacttaccttcaacaacaacgattttacataacactactggcgttaaagaaatggggtggcaaagatagaaagaaaaattctactggagaatgtatgaattttgaggtaatttttgggatgccattgctgttagagatcatagtattaggtgcacaaaatgaacaaggagttctccttaaggacatacgaatccacaaaagggtatggaaatttctacatagtattgtgattatcgtgtagaaataccgattacattttgaggattcctatatcccggaggaaaaacttctggtattctgtatacataatattgtagcctttaccaacaatggaatccgaacaattatctcaaaattcacccaattatcacttctatcggctggtgttcgtactactactgttggaatgaaactttaaaatatcattcattcggtaatattcctctaaacaattctttttctcaacctagcaaagtaacccacacttaaacttattacgattgttcctcattgctaattcatattccagcatctttgatatatcatattttgtctaaatatcgtctaccatgatgatattcatgaagaataaggtttttcaacctactttgatccgatatagtgtaacggctatcacatcacgctttcaccgtggagaccggggttcgactccccgtatcggagtacttttttgatggctacaatcataatttgacatacctcatatgaatatgatgtggtagtaaattaaataggctgaatcctgatagtttgagcctgggttctgactatccgagaagcgcacagcaacataacaccaccttcttttagtcttttagcgaaaaagtaggaaggctctgcactccatcgtttttaccattcctacacgttataaggactcagacaggcggcgtagttaaaataaattaacaccgagtcttgaacatgtaatttctttaggttcattgaagagataattataactttcctgcccacaagtcctctgatttacattcgaacgaggctcattaacgtagtgaaaactgttcataacgcaatctcttatgaaaaccatgcggtgaattccttttgacaggttctctatgatactatcgacgcctctcaaatatcaatgcgtattactgcatcagcaaagctccgtcatctacatctaggccggggcatctttcgcagcgaaatctttacggtggcaaaaaataaagaaaagtgaatattgaacaccaattacaagaaaagggagcacctgtcaatcgaataaaaaagaacaaacttcgggcacgtcttttaaataggttcatatacaatactaagaaagatatattaagaaatggatattattctgggcatccgtgtacaggattctgtcattctagcgtcttctaaggcagtcacaagaggtatttctgttttaaaagattctgatgataaaacgagacaattatcgccacatacattgatgagttttgccggtgaagctggtgacaccgttcaattcgccgagtacattcaagccaatatccaattatactccattagagaagattatgagctctctccacaagcagtatctagttttgttaggcaagaattagccaagtcaattaggtcgagaagaccataccaagtcaacgtattgattggaggctatgacaaaaagaagaacaaaccggaactatatcaaattgactacttgggtactaaagtcgaattaccctatggtgctcatggttactcggggttttacacattctctttactagatcatcattatagacctgatatgactactgaggagggtttagatttattaaaactatgtgtacaagagcttgaaaaaagaatgccaatggacttcaagggcgtcattgttaaaatcgtggataaagatggcataagacaagtagatgacttccaggcacagtgaaagatattcagtgtaatcacacggaaaaggtgattgctaatgatatactaaagtaattatcttcctcgttcataaaattaaataaagttattatagttttttcatccgttataatagcaaatgtatcagaaataagacaatttctcattttttgttggcagagtgagatatcatctgatctattgcaaatgaatcccaatcaatgctgataccgcttcgttataaccaattcgaaaagttgtaattatgttacccgcatgagaatattttgaagaagcaatgtagggctacgatagtacttttgagatggtttattacttgttcaaatgctgtcatctcatgttgttaatgcgctatatttcgcactacgaagctaattttcaacataggtaacacaaagatattagagatgtctgatatatcgaaactcataggagctattgtgggatctgatgaccccgttatcattgaatttgtgctgaatatcataaataaatccggcaatttacaagagtttatacgaaatattcaaaaattggatgccggtatatcctacgaagacagtattaagatgtataatgcatttttaggaaagcaggaagaagaaaaggtacgaaataaagttaaaagttcaccgttaagtcaaaaaattaatcaggtactgaaagatgacgttaatttggacgaccctgttgtgactgaattcgtcctgagcattttgaataaatctaaatcaataactgagttccaggaacaactgaacttgatgcaaagcggactcgataatgaaacaattttcaagatatatcaaattgcatcaccaccagtaatgaaagaagaagtctcagttcttccaagcaccaagataccagcaaagatagaagcaaagattgaagaagaggtacaaaaaatagaaagtttagaccccagccctgtccttcacaaagtttatgaaggtaaagtgagaaacataactacttttgggtgtttcgtccaaatttttgggacgcgaatgaagaattgtgatggcttagttcatatttcagaaatgtcagaccaaagaacattagatccacatgatgtggtgagacaaggccaacatatctttgtcgaagtgataaaaatacaaaataatggaaaaatatcgctctccatgaaaaatattgatcaacatagtggagaaatccggaaaagaaatactgaaagtgtcgaagatagaggtaggtccaacgatgctcatacaagcagaaatatgaaaaacaaaattaaaaggcgtgctttgacttcaccagaaagatgggaaattcgccaactaattgccagcggtgctgcttccatcgatgactatcctgaattgaaggatgaaatacccataaatacttcctatttgaccgcgaaaagagatgacggcagtatcgttaacggtaatacagagaaagtggactcaaaattggaagaacaacaacgagacgagacggatgaaattgatgtcgagctgaatacagatgatgggcccaaatttttaaaggatcagcaagtcaagggggccaagaaatatgaaatgcctaaaattacaaaagtcccgagaggatttatgaatcgttcagcaatcaacggctctaatgcaatacgagatcatagagaagaaaagttaaggaaaaaaagagagattgaacaacagattaggaaacaacagtcgtttgatgatcctacgaaaaacaaaaaagattccaggaacgaaattcaaatgttgaaaaaccagctgattgttactgaatgggaaaaaaatagaatgaatgaatctatctcgtatggcaaaagaacttccttaccaatcagtgcacagcgtcaaactttgcctgtatacgcgatgaggtctgaattgatacaggctgtgcgtgacaatcaatttctggtcattgttggtgagacaggttcgggtaaaaccactcaaattactcagtatttagatgaagaagggtttagtaactatgggatgatcggatgtacccaacctcgtagggttgccgctgtatccgttgctaaaagagtggctgaagaagttggctgcaaagttggccatgacgttggctataccattagatttgaagatgttactggcccagataccagaataaaatatatgactgatggtatgttacagagagaggcgttgttagatcccgagatgtcaaaatattcagttatcatgttagatgaagctcacgaaagaactgtggcaactgatgttttatttgcgttgttaaagaaagcggctattaaaaggccagaattaaaagtaatagttacatcggctactttgaactctgctaaattttctgagtactttttaaattgtccgattatcaatatacctggtaaaacttttcccgtggaagtactctactcacagacgccccaaatggattacatagaggcagctttggattgtgtaatagacatccatattaatgaaggcccaggcgatattttagtctttttgactggacaggaagaaatagactcatgctgtgaaattttatatgatagggtgaaaactttaggtgacagcatcggcgaattactgattttgcccgtttattctgctttgccaagtgaaatccaatcgaaaatttttgaacccactccaaagggcagtcgaaaagtcgtatttgccacaaatattgcggaaacttcaatcactattgatggaatttattatgtcgtggaccctggatttgcaaaaatcaacatttataatgcaagagcaggtatcgagcagttgatagtgtctccaatctctcaggcacaggcaaatcaaagaaaaggtagagctggaagaacaggccctggaaaatgctatcgactttatacagaatccgcattttacaatgaaatgttagaaaacacggttccagaaattcaaaggcagaatctttctcatactattttgatgctaaaggccatgggaattaatgatttattgaaatttgacttcatggatccccctcccaaaaatttaatgcttaacgcactgacagaattataccacctgcagtcactagatgacgagggaaaactaacaaatttaggtaaagagatgtccttatttccaatggatcccactctatcacgctctttattgtcatctgttgataatcagtgctcggatgaaattgttactataatctcaatgttgtcagtacagaacgttttttatcgtccaaaagataggcaattggaagcagatagcaagaaggcaaagtttcatcatccatacggtgaccatttaacattattgaacgtttatactagatggcagcaggcaaattactcggagcagtattgcaaaacaaactttctgcattttagacatttgaaaagagcaagagatgttaaaagccaaattagcatgatatttaaaaagataggcttaaagttaataagctgtcatagtgatcctgatttaattcgtaaaactttcgtgtcagggttcttcatgaacgctgctaagcgagactcacaggtaggttataaaaccatcaatggtggtacagaggttggaatacatccctcgagttcattgtacggaaaagagtatgaatacgtaatgtatcatagtatcgtattaactagccgggaatacatgtcgcaggtaacatccattgagccccaatggcttctcgaagtagcgcctcatttttataaagctggagatgctgaaagccagtctaggaagaaagcgaaaatcattcctttgcataacaagtttgccaaggatcaaaattcatggagactaagctcaataaggcagtcaagggaaagggcattaggtatcaagaggtaacattgttagctttttatgcattataattatcgagttttatagacctatatttaattttttaacaactttatctctcttgagaatttttacatgaaaaaaatcacagagtaacgctaacctttctttaattgaaagctgccattgctcgtttagttacaaaacgcctttgaacttgccttcgacactttgttgcttcggagtcgcggagtattcaaaaaaagaaatagtataatagagagaacaatagagatattcgcgaagaacaccaattcaaacatatcgagtaaagtgcaattgagaacgccaaaaagagcttgtataatgttattaccattaacaaagctaaaaccgagagcaaaagttgctgttgtagggggtggcgtttctggactatgttttacttattttttaagcaagttgagaccggatgttgaaatcacactgttcgaatcgcagaacagaactgggggttggatatattcttgtaacacaagagatatgagtgggaacccaattatgttggagaagggacccagaacattgaggggcgtatcagacgggaccgttctgattatggatacccttaaagacttgggcaaggaagcagttattcaaagcattgataaaggttgcattgcagacaaaaagtttctactagaccccagtgataaactcgtgcaggttcctaattcgatatctacaacagtaaaatttctgctgaatccgttgggaaaaggactcatcacgggtatgatgggagaatggttcagaaaaaaatctccacatcctggccaagacgaaagtgtcgaatccatttgtgacagaaggtttgggaataactacatatcaaacaatatgatcagtgccttactaagaggtatctatggggatgacgtttccctattaagtgccaagagaacgtttaagaaaatatactacaatgaactaaagcacggatctaacacacaagctatgattgataatatgcgcggaaagtcaagaagtaaaaaaactgagaacctgcaccaatctttaactggctgccttaacgactactcaaatgcgtttggaaaagacaggtcaaagttattagacttatccaacacgctaaagaaatatcccatgttgggtcttgctgggggactagaaacgtttcccaagatagtcagaaatgctttgaacgaatttaaaaacgtcaaaatagttactgggaacccggttacgcaaataatgaaacgccctgctaacgaaacgacaatcggattgaaagcgaaatctggcgaccaatacgaaacatttgaccatttaagacttacgataacacctcccaaaatcgctaaattgctaccgaaggatcaaaattcattatccaagttattagatgagatacaatcaaacacaataattttagttaattattatttgccaaacaaagatgtaatagatgccgatctacaaggctttggatacttggttcccaaatccaataagaatccagggaaattgcttggtgtaattttcgattctgttatcgaaaggaatttcaaaccactttttgacaaactctccacaaacccaaacgccctcaacaaatatacaaaagtgactgcgatgataggaggttgtatgctcaatgaacacggtgttcctgtagtgccatccagggaggtaaccattaatgcagtcaaagatgcgctgaacaaccacctcggcatcagtaacaaggatctggaagctggtcagtgggaattcactatcgccgatagatgtctgccaagatttcatgtaggttatgacgcatggcaagaaagagctgaaaggaagttgcaagaatcttacggccaaacagtttctgtggggggaatgggattttctagaagtcccggtgtccctgacgttattgtagacggctttaacgacgccttacagctaagcaaataagtacgtatatatatggttagctttacgcaaactacttcttttgacaattgaggcagttatcagctaataagaaaaagtagttagtatcaaaagacacaatttatttatattaaccaaatttttcagaacatcctccggaccgtcagtctttaacgccgagccgccgatgatgggttggagtcaaaacgagggaactcaatattaattgcggagttgagcgatgatgggttggaactatataaagcatcggaaacgcatggctaagggaagtggaagaatgcaggttacaaaaaacggataagaacaaacttgtttcgaaatatggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttaggtacttatgacgatttggaacacattcaaactagaaaaaactttgatgtaggatatccctatgcacatccatacggtatacatagtgaacgctcactgtgtataatggactaacagtagttataaacctgctttcgttactacagcacacaagactattgtactttgttaaagaactataagattaaagacatacataattccaactatttataccattaaatattcttcttaagctttttttcgcggctttctataatatatgaggatcaattagtgaaagcaatgctctctatgttggaaccacagtgtagatactgcactttcataaagcgctagatatagctggtcaatctagcggagtacatgggtcacagttaccattctcgtaacttgacttggtgcactacgggtcaagatgattgaaaacggctcccacaacttcaactgaggtctgtttcagatggaggtgcagtgttttccatgtagtgagccctgatatcggggcgtaatcacctaactcagcaaaggtaaacctttctcatctgacggagataaagtgatagtaatcggggatgcggcgacagagattgaagttaatttgaccattgaatagttgcttatatatgatagacttagctaaaagaaaataatgaaggcgtaccccatatcgctgatcagagaaatccatgtagatagaatttctgtctccgctaaaactgcatgagcgactgactgaagctctactcattcaaaaattatccctcttcacttcccgtattcacacttgttgccactatggacatgctctctttgaaaaatgtagtctcacccacagaaaagaaaagatcatttgaaaataagatatcctgggaaacccgcttgaattattccagtgtttctacctaaagaaaaatcacgcaaccagaaacagatttcgtctgggttcgttcaacaactctttgcttaagatttaattagcatatgctaaatcgccattaggagcaaaaccagggcttctaacgatttccaataaagaagatacggaacttttcatgtgttgacaacaacattacagggattttttcagactttcatgttaccggtcaatctgctgatgcatacatacaggtataaagaacactttgcctagaacaataaagaaaagtcaaagacatctgagaggcatcttcttacctgaaagagacgccttgtatcttctataggtcaactagagtaggtgttccggaaacctgaatgaacttgaagaccattcccaactccactattaattaaacttagtacgctcgagtttaccatgtgaaccgaaggcatgtaaaaatgtaggctattcttgtgcttatgttcttcctaacgcgactacgcgtttgaagaagttagtagcaaaatggcgaagaaaacaaacacttgaaacaagtcaaaaaaaattgaaggcagactcaaaagcaaggataatattccaccaaatcagggacgaagcaatgagtgcgggtatcggagaatcacgtacagagttgcttacatggttgaatggcctccttaacttgaattacaaaaaaattgaggaatgtgggacgggagcagcatattgtcaaataatggattcaatttatggagacttgccgatgaacagggtaaaattcaatgccacggccgaatatgagtttcaaaccaactataaaattttacagagttgctttagcagacatggaattgagaaaacagtgtacgttgataagttaatcagatgtaaatttcaagataatttagagttcttgcagtggttaaagaaacattggattcgacataaagatgaaagcgtgtatgatccagatgcaaggcgcaagtatcgtcccattataacgaataatagtgcaaccaaaccccgtacagtatccaaccctaccactgcaaagaggtcatcaagcacaggcactgggagtgccatgtcaggaggattagcaacaagacattcttcgctgggaataaacggtagcagaaaaaccagtgttacccaaggtcagttggtagcgatacaagcggaattaactaaatcgcaggaaacgatcggttcattgaatgaagagatagaacaatacaaaggaacagtaagtactttagagattgaaagagaattttacttcaacaaactacgcgacatagaaatcctggtccataccactcaagatttaataaatgaaggtgtttataaatttaatgatgagaccatcaccggccatggtaatggaaatgggggagcattattacggttcgtcaagaaggtggaaagtattttatatgctactgcagaaggatttgaaatgaatgatggtgaggatgaattgaatgataaaaatctgggtgaacatggaactgtgccgaatcagggcggctatgcgaacagcaatggcgaggtcaatggtaacgaaggtagtaaccatgatgtgataatgcagaacgacgaaggtgaggttggcgtgagcaacaacttgatcatcgacgaggaaactttttaagttgagaactaaaaagcagtattgttttcgaatatgtattatttttttttattttttttattactcgttatcaatatatatatatacatgtatattattactaaaagaatgagaaaataagataggatcctggaagggggatcaggtaaagatataaagtgagatgaagaagccaccgttttatttcccctttaatttgttgctgcaggtgcctcaggcggttcggtattgctctttggatccaaatatttttcaaaagcctcgttcctttccttgaatggccttggacccaataatctaatcatgtcttctctagtaattgcttccttacgtagcaattcttttgcgacaagatcgactttgtccaaatttttggttagcaattctgtacaagctcggtgtgcatcatctactatagatttaacttctaaatcaatggttcttgccgttttattactgaagggtttgttaactttgaagtttccatcattctgatcaaacgacaggtagccaatcttgggtgacattcctagggatgtaaccatggcatttgccatctgtgtaacctttttgaaatcatcatgagcaccgctagtcaccgatggaaaatgtagctcctcagaaacacggccaccaagagccatgatcattctatgtctgaattgctcctcagatatcaaatattgatccggtggtaggtactgggcatagcctaaagcaccttgtccacgcgggatgatgcttactttcagaagtggatccgcatattttagaaaccaaccacaaacggcatgtcctgcctcatgataggccactgaccttttttcttccttagaaaggactcttgttttcttctctagtcccgcaatgactctttcaatggcttgctcaaagtgatggatagtgatatatgggtcattatgtctggcagcgattaatgcagcctcattacaagcattagcgatatctgcaccagtaaaacctggagtaagcgtagccaatttcccagaaagattattcatatcatctgtaagaaggggatccagattcagtcttttcaagtgaaccaggtatatttgctgcctaccattgacatcaggagaatcaatttggatatgtctatcgaaccttcccggtctcatcaaagcattatccaacacatcgggcctatttgtacccgcaaggactacgacttggtcggaagtagtgaatccgtccatttccaccaataattgattcagcgtagcttctctttcatcgttagcgccaccgagagcgccgcctttgcctctttctttaccgatagcgtcaatttcatctataaagataatcgagggggccatagaccttgcttgagtaaacaagtctcttacacgtgaagcacccaccccaacgaacatttcgacgaactcagaacctgatactgacaagaagggcacgttcgcctcacctgcggtggccttggccaagagagtcttaccggtacctgggggtccagaaagaatagcgcctcgtggaatcttggcacccaatttagtgtacttacctgggttcttcaaaaagtgaacaaattccatgatttcctgtttagcttcatcacaaccggcaacatttttaaatgaaattttaatgtctgtttccttattgaagagctttgctctggattttccaacattaaacatgccgccgaggcctcctccaccaccaccattggcatttggtggtgaactatttatttttctggttatgaagtaaaggccaccaagcagaatgatggtgggcaggaaggggaacaaaaatgtgaagggagaagatctctcaatgtatttgatggggatacgatcccgaggaggaatgttcaagaggtcctggatctggtccatctgttcctcaaaaatatctactgaaccaatggtgaacgatacaacttgctttgtattgactaattcggcctctacgagaaacttattaacgacgtaaatcttggacacaagacccttctccaggtattttgttttgaaatcctggaaagtcaagacgcggttagagtcgtctcctgagttgttactggaaggtgtgagcaaagtaaatataattgtgaatccgatggtcaaaaacatcgtattagcaaattccttagatctgaagtattctgataatgaaccaaactcatttcttttgtctttgccatcttctttattgctattattatctttattaccattgttcttgccctcaccctctttgtttggcctattttcatttaaccttgtccatgagatatggaaggaacgtatttgggtagaacggtgtattgtgtttctggttgccagaccagataacgtctgcaaacgctggtgaactggcatgcgcgagcgaagcactggcttcactgttgatatgcggctagctttaccaaatgagagtgatgtcaatgagcgtggcgcaccccttgcatatcgttgccacatcatcatcacttagtatattataaaataagtggatgatgcctttatttgaagactgcgttaatctcctttaatatagaatgggtccttgtaaaagttatgtatagacagtaagaaccaatttattcctcatctaaatcataggcccagaataaactgaacagatgcgtataaaggcgttataaagatgccagaagcatatcgcgggccacgactaaaaatgccgcgaggtcgccctggacggtaagcacgtgctcaagtgttgcccgactcttggggtccagcgccgggtgagagtttccgatcacgtggtctccgtgcatcgcgacttcgatccagcagcgtgaatcatcgccgaatacgaaacgtacgtcatgcacatcgctggctccgggtagtacacgaagctgcaacagccgttcgtacagtgcgacctctgcggcatcgttacccgactgcgcagcccaacgtgcgcgtaattggacacactctttaccacgctgttgcagcagcgagtccagctcgcgcgattgggctgctaaggtcgactgccgtctagataactcagattcacgctcgtgatagcttctccactgctctctggtggtatttgtagcttgttgggccgcatgtatttgttgctgcagagcggtgcgctgggtggcaagccgttgcagttcatctatgagatgttggtgttggttatgtaattgacgcatttccgcttggaactgttgcagctgttggcgcgcgtggttttgctgacgtgccagtacctgggccacgtccttttggaacccgtccatccggcgctcaaggtccgaaaatgcgtctatgctggccattcttgtatgtgtgtatgtgttgtatacgtatgagcggttttaattgaatcggcttagcctgtttttgtttttgtttttgttttgttttggtttggtttgatttattttggtttggcttaaatcttcgaggaaatttgcgctttccgcgtaaaaagggaaaaaaagcagatatatgtacaacagaaaagacagagatgttcacgagaggaaggaagatggtcaatctgagtttgaagcactgaacgggaccaacgcaattatgtccgataatagtaaagcgtattccataaagtttctgaccttcaatacatgggggttaaaatacgtctccaaacaccgtaaagaaagactcagagcaattgctgataaattggcgggccactcaatgcttacgccaatatctgacgagttgttgcccaatggtggagatagtaatgaaaacgaagattacgacgtgattgccttacaagaaatctggtgtgtggaagactggaagtatctagcttctgcgtgtgcctccaagtatccgtatcagcgtttgttccattctggtattctgacggggcctgggttggccatactgtccaaggtcccgatagagtcgacctttctttaccggttcccgataaacggtagaccgagtgcggtgttccgtggcgactggtacgtagggaaatctatagcaatcaccgtattgaacacaggaacccgccccattgcaataatgaacagtcacatgcacgccccatacgccaagcagggtgatgccgcctacttgtgccacagatcttgtcaggcctgggatttcagcaggctcattaagctttacaggcaggccggttatgcggtgattgtggtgggtgacttaaactccagaccgggctcactgccccacaaatttctcacgcaggaggccggcctggtcgactcctgggagcaattgcatgggaagcaagacttggcggtgatcgctcgtctgtctccattgcaacaattgcttaagggctgtaccacgtgcgattcgctgctcaacacatggagggcccaaagacaacccgatgaggcatgcaggttggattatgctcttatcgaccctgatttcttgcaaacagtagacgcaggtgtcaggttcactgaacggatccctcacctggactgcagtgtctctgaccattttgcatactcatgcacccttaacatcgtcccacagggcacagagtcccgtccatccacctccgttaagcgtgcgaagactcatgatagagagctgatcttgcagagatactccaactacgaaaccatgatagaatgcatccacacgtacttgaagacagcccaaagacagaaatttttccgtggcctacatttctgggcctcaatacttctcctaatagcgtcgttggtcgtgacaacgtttactgcaaacaaggcaggctggtcctccatcttctgggtccttttcgctattgctgtctccatctcgggcaccatcgacggtgccatctccttcttgtttggcaggtctgaaatcagagccctcatcgaagtcgaacaagaggttctggacgcggagcaccacctgcaaactttcttgagcgagaaatgatattatcgattttctttagcatatgtaaaaaaattactgatattatataatgtgtgtaaatttcgtcaatagatgcaaagcaatcacggagaagatgaaaccgacagataggaacaatacgacaagggagtcgactctgaatccattggcttcgtccgtatataacttcaaaattgagcttgaagacccaccgtaaccagcctgtctggtggaagtgggcgtttgttttgcttgcttttccttaatggattgtgcctgtcttctcttctgcaagatacgctgacctcctggtggaactgaagctgccattcttatgatactgttgatcgataataccacctgttttatgctttgcgccccttaccttttctcacacgcacatatatctactctctcatacctcttatatctaaaatgtctcttttggccagttagtaactgaatgaaaaagtgaaaatggaggaaaaaaaaaaagacgaaatccaaaaggctaaggaaacgggtaacccgtggtacccggggcagaatcaaacttataattactaaagatataccatatattacgatccctgcgcccggcgtgctccacattaagtaaatgtctggagtaaaatgaagtccgccaattcagtcacaaaacatgactactgcctcgttcgcgatttcttcttcccttacttcatcatgttcaagccccctcagctgcgcccaaatgattcttcttatcctcttgcatactgcaccgaaaaaaaaagttaataagcagcaggatttataggcgcgtgcgtgcagccttagactgaaggggtggaaaaactttaggtaggtttggttctcactacccaaagagcaatcgataggtataaaagtgagcaattgctatcacagcgagccttattgttacagcacaaatcacgcgtattttcaagcaaatatcatgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatgaatgcacagctaaaacagagacaaaactgcatgcctcttctcccctttattatcacctttaaaaaagataaaaaaagaaactggaaaaaaggtaaaaaaaaaaaaaaaattaaataaatacgaatacgttttctcatgaccattgtactagtaatcacaaccatgatacttgaataacttttctgttttgtgctgtattaagcacaaccgttattttttaatttatagcgttataccactatattattgtagtcattatagttattatcccgggtaacaaaaatttcattccaacgaggtaatagttccacttttcaggcaggaggacgaaaaacatttgccacccaagaaagagacaaagcagtaggtaaggcattcatcacacaatttgaaagggggtatagtaaaaaaaattcaattgagcaaatagaatggctagcactgcagtaatgatggacgtggattcttccggggtcaatgacttgcaccattctgagaagaaatatgcggaagaagatcaggttcaggaactattgaaagttttgaatgagatctccaagaccactttaacgctggacccaagatatatatggaggagtttaaaggacttgagctctttaaggaaccaggagcttttgaatgcggaaactttatgtttcacagtgaatgtgctgtaccctgattcttcttcattcaagaagaatctgctgaagttcattacttctaaccataaatcgtccgtaccggggtcagctgagcttagaaactcatatccagcctctttttattccgtaaacactgagaaaaagaccattgaagtgacagctgaaattaattgcttcatgcatctactagtccagttgtttttatgggacagtaaagaattagaacaattggtagagtttaataggaaggttgttatcccaaatttattgtgttattacaatttgcgttccttgaatttaatcaacgctaagttatggttctacatctacttgagtcatgaaacgttagcgcgcagctccgaggagattaacagcgacaaccaaaatataatcttaaggtccacgatgatgaagtttttgaaaatcgcttccctgaagcacgacaacgaaaccaaagccatgctgattaacttgatcttgagagattttttgaataatggcgaggttgatagcgcgtctgatttcatttctaaactagaatatcctcacacagacgtttccagttcattggaggcaagatatttcttctatttatcgaaaattaacgccattcaactggattattccactgcgaacgagtacattattgcagccataagaaaagccccacataattccaagagtttagggttcttacagcaatcaaacaaactgcattgttgtattcaattactcatgggtgatattccagaattatcatttttccatcaatcaaatatgcagaaatctctccttccttattaccatttgaccaaagccgttaaattaggtgacttgaaaaaattcacatctacaatcacaaagtataagcagttgctattgaaggatgacacctatcaactctgtgttagattaagatctaatgttatcaagacaggtatcaggatcatctccttaacgtataaaaaaatttcattaagagatatttgtttgaaactgaatttggattcggagcaaactgtagaatacatggtttcaagggctattagagatggtgttattgaagccaagattaatcacgaggatggctttatcgaaaccacagaattactaaacatttatgatagtgaagatcctcagcaagtatttgatgaaagaatcaaatttgccaaccaattacatgatgaataccttgtttcaatgaggtaccctgaggataaaaagactcaacaaaatgagaaaagtgaaaatggtgaaaatgatgatgatacgctagatggtgatttgatggatgacatgtctgatatctcggatctcgacgatttgggattcttataagggcgcataaaaaataaataactaccattcataacagaaattcattcgtatatacataaagttctcataaacgtatatatatatatatatatatacttattgatatcaaagtgtgttactttctacattcatagacggggaagaaaagtgaggaaaagttgttttctcttgtgcactgcagccctttgaaaaagtagaactgcagaaaaaataactgaacgtaaagcattatttacttttcaaaggcaaaagagatagagccaaaaaaattgtaagcagcttaaaagccataatgacaacggaagatccagattcaaatcacttaagttccgaaactggcattaaattggcattggacccgaacttaattacattggcactaagttctaatccaaactctagccttcattcaccaacgtctgatgaacccgtacctgaatctgcaggaaaagcagatactagtattcgactagaaggtgatgagttagagaataaaactaagaaagacaatgataagaacttaaaatttttgaagaataaagattctctagtcagtaatccacacgaaatttatggctccatgccgttggagcaattgatcccaatcatcttaagacagcgtggtccaggctttaaattcgttgatttaaatgaaaaagaattgcaaaatgagattaagcagcttggtagtgatagtagtgacggtcataacagcgagaagaaggacactgatggcgctgatgagaatgtacaaattggagaagatttcatggaagtggattatgaagataaagataatccagtggattcacgaaatgaaacagaccacaaaacgaatgaaaatggcgagaccgatgataatattgaaacggtaatgacacaggaacagtttgttaaaagaaggagggatatgctagagcatataaatctggccatgaacgaatcgtctttggctttggaattcgtttctttgctactgtcgagtgttaaagagtctacaggtatgtcatcaatgtcaccatttcttaggaaagttgttaaaccttctagtttaaacagtgataaaattccatatgttgcacctacaaaaaaagaatatatcgagttggatatattgaataagggatggaagttacaaagtttaaacgaatctaaagatctcctacgcgcaagttttaataaactgagttccatattacagaacgaacatgactattggaataagataatgcagagtattagcaacaaggatgttatttttaagattagggacaggactagtggtcaaaagctgttggcaattaagtatggttacgaagactctggatctacctataagcatgacagaggtattgctaatataaggaataatatagaatcacaaaatttggatttgataccccacagtagttcagtgttcaaaggcactgatttcgtacattcagtaaagaaattcttaagggttcgtatcttcacaaaaatcgaatcagaagatgattacatattgagtggcgaaagtgtgatggatagggatagtgaaagtgaagaagctgaaacgaaagatatcagaaagcaaatccaacttttgaaaaagatcatttttgaaaaagaactgatgtaccaaataaagaaagaatgcgctttgttgatttcctatggtgtcagtattgaaaacgaaaacaaggtaataattgaactacctaacgaaaaatttgaaatcgagttgttgtcccttgacgatgactccattgtcaatcatgaacaagacttaccaaaaatcaacgacaagagagcaaatttaatgcttgttatgttgagactattattagtcgttatattcaagaaaacattacgatcgagaataagctcaccccacggactgatcaatttgaatgttgacgatgatatcttaataatacgtcccattcttggtaaagttcggtttgctaattacaaactgttactaaaaaaaatcataaaggattacgtgctcgatatagttcctggctcaagtataacagaaacggaagttgagagagaacaacctcaagaaaataaaaacattgatgatgaaaatataactaaattaaataaagagatccgtgccttcgataaactattgaatatacctagacgtgaactcaaaataaatctaccattaactgagcacaaaagccctaatctaagtttaatgctcgaaagtcctaactattgtaacgcactcattcacatcaagttttcagctggtacggaagccaacgcagtgtcctttgacacaacattttctgattttaaagaagtagaggacttcctacattttattgtcgctgagtacatccagcaaaagaaggtgtaatatcctgagtcactccttaaacctacatacattgccatagaatgccatttattactatataaagtcgcatacgtacaaaaggacaagatcttatcttcgaaaacaagaatatgaaggatttaataacattgccaggttaagaacggtgtaacaacaatagaagtaacacaacaccaatagcaaacaaaccaactacagatatgacttacacattggcaattttaggctgcggtgttatgggccaagcacttctttccgccatttataatgctccaaaggcggctgatgaaactgctgctgcattttacccttccaaaattatcacatgtaaccatgatgaacctagtgcacaacaagttaccgatctagttgagacattcgacgaatctcctaacggtattaaagtcgaaagcacttacggtcacaacgtgagcgctgtcgaagaagcttctgtagttcttcttggtaccaagccatttttggccgaagaagtgttgaatggtgtgaagagcgtcattgggggaaagctacttatttccctggctgctggctggacaattgaccaattgagtcaatacactagcactgtttgccgtgttatgacgaacacacctgccaagtacggatatggttgtgcggtggtgtcctactcagctgatgtttccaaagagcaaaagccactggtcaacgaattgattagccaagttggtaaatacgttgagcttccagaaaagaacatggatgctgctacggctttagtcggttcaggccccgcttttgttctcttgatgttagaatccttgatggagagtgggttgaaattgggaatcccattacaagagagtaaggagtgtgccatgaaagttctagaaggaacagtgaagatggttgagaaaagcggtgctcatccatccgttttaaagcatcaagtttgcacaccaggtggtacaactattgccgggttgtgcgtaatggaagaaaagggcgtcaagagcggtattatcaatggtgttgaagaggcagcccgtgttgcgtcacaattaggccaaaagaagaaatagattgctttgcgtgaaatgtatgtatgttcgctttgtagccgtatattatttttttattactgaccttgcattttttcgtcattttcccgtcggtccgataatgaatcatcacgatgaatgactaccccataataatgacactaattggagcgtataaaagaaaaaaattatataaatgtgtttgtaatgagtaagagcaattgattcatttgaaatgaaaatcaaaaatcaaaattaaaataaaactaagcaaccatgtcaagcggcagtactattgtttcgtctgacaagtcggggcgaacatttaagcatgaggaagaactacccaagttaccattacctaaactctgtgacactttgcagcgtctgaaggagagtttagagccattgtattatgctgatggttactatcaacatcctttagatccagaacaaattgagaagctgtcatccataataagagattttgaagagaatcccgtaagtgagaagctgcaatctaaactacagagctaccatgacactagggattgctaccttgatgaattacacttagacatcaataaccagacctccactagggagattcaggacgatgtcctacccaggaatcccttcttggttctcgcagatgacgctttgccaaacatcactcaagctgataggtcagccgtcctagtgcactctgcggccaggtttatttctgctttgaaacaagatttgttgccaccagatatcaatgccaccaatggcaaaccactgtcaatggctccatttctgaacttgttcggtactactcgtagtcctgtttttcagcgcggtgaggttgaaaattttgatttgaacaaaccttacacagcatctgatttagaagaccctgattattcaagcgatgaggacgataacgacgaacccacccaaaaagactttgatgaccgtaaaagaaaacacgaagaagacatattcactggcaatggtataactataaaaagacatccggatagcaaacacatcttgatcatctccaggggccaatactatacactggaagtacttgattcgacgaataaaattatatacactgctgcagaattaaccacaattttcaaccatataataaaagattcttctggcattgaaaaatcaactgcgttaggtagtttgacctctcactcttttagaaactggaaatatgcaaggaagagactacagaaaaggtatcctaatgaattacatcgcatagactctgctctgttcgtgttagtgctggacgaatcacaagaagaaactaccaatgatggcgatgataccgctgatatcagtcaaatgtttaacaggactatcactgagcgagacaagaaatgtacttccgccaattgtaagagagtgttttacggtacttctataataaatagcaaaggccatcaagtgggttcatgtgtttctcgttggtatgataaattacagttagttgtcactgcagatgcaaaagccacagtgatttgggattccttcacatgtgacgggtcagtcgtgcttcggtttacttctgaaatttatacagaatcagtcttgagattagctagagacgttaacgccggtgacccacagttttcactctggcctaacgtgacacaaatggatcctgaaactaaaaaactgatgacggcgaccataagtgccgacggcggaggcccttctgaaattgaccctaagttggttgtaaataaaatcgattggtctttcagtaacatcctgaacacacatgtccatttgtcagaaaccaaactagctgatctgatttccaagtatgatattgttcgcgcttctattccattgggcagaaggtcagctcaaagattaggagtcaagcccgattcgatggttcaagtagctttacaaatagctcactatgctttgtatggaagaatggtgtttggattagaaccagtatccacacgtggtttcaaaaactcgagatcatcttttattaacattcaaagtcaagcgctgttggaactatgtcaattgtttatttctagctccattgatgggacagataaattagacaaatttatccaaacctgcgaaacacataataacatggttaaacatgcaaagtctggggtaggttatgaaaaacacttcaatgcattgaaatatctcttcaaatttcatgaccattttggtatccacttaagtggtgatgaatcatctgctgcgaaagatcttttcgaaaatccacttgttttacctttctcacagcctgagttgattgttgccaactgtggtaatgctgctaccacgacatttggtataactcctgctgtacctcatggctttggaatagggtacatcattaaagatgatcaagtagatttgaccgtgacatcgcaatttcgacagggtgacaggttaatgtttatgttaagttgggtgttaggcgaaattcgttcctactggaggatgtcacgcggcacttctcataataaaactggcgtgaagatcagtccagtggtcgataaattgtatgaaatggacaatgcagtcaataatcctccgaaacgtaacggccatacagtcaatggctcccgcaaaacatcttcttcatcacaggtaaatttgaacaggtatggcgggtttttcgatttggaaggccacattgacagtaggaatatatctaaaacaccatcgatgaagaatttgcagaaaaccttcaatggcttgaccatgagcgcagacaatgatcattcaagttccgcagtttccgttcccacagaaaaggaaaaattaaatacaggccatgaaattttacagatccaaccgcgggaagtggcaagtaatgggttggaagcagatgatgagacagatattgaaatagttgctggcaatgctgatggcacatcctcttcggcatcttcagctacatctctaaattccaagaaacgtaacgtcatcaactcaagattcgatattgattttgaccgcagtcgtgtgggtagaaaggtggcgaccttagatcaataagaacgctctttgtttatctatttattactagcattatgcgtaagcttggcgtgatgtgatatatacttgttatatgaagtatatcaatatgctttaatttatgcttattatttgctctcatgtcagtaacccggaccagatttgccattgaaaaaattttcatagaatagcccgatgctgatcatcagtacaaaagacagagatttcatctcgacctgtaccaggagctaagcaaagagggcggaaagagcgtaatacaccgttaacatcgcgcattagaggtagacatgagtgacttacaagaccaagaacctagcattattatcaacggtaatttggaaccagttggtgaaccagatatcgttgaagaaacggaagttgtagctcaagaaacacaagaaacacaagatgctgataagccaaagaagaaagtcgccttcactggcttggaagaagacggggaaactgaagaagaaaaaaggaaaagggaatttgaagaaggtggtggtttgcccgaacaaccattaaaccctgatttttcaaaattaaacccactatccgccgaaattatcaacaggcaagctacaataaacatcggtaccatcggtcatgtcgcccacggtaaatccacagtagttagggctatttcaggtgtccaaacagtccgttttaaggatgaattagaacgtaacattactattaagttaggttacgctaatgctaaaatttataaatgtcaagagcctacatgtcccgaacctgattgttatagatcattcaaatctgataaagaaatcagtcctaaatgtcaaagaccaggttgtccggggcgttacaaattggtccgtcacgtttcttttgttgactgtcccggtcacgatatcttaatgagtactatgttatcaggtgctgctgttatggatgctgcgttactgttgattgcaggtaatgaatcttgtccacaacctcaaacctcagagcatttagctgccattgaaatcatgaaattaaagcacgtcatcatcttacagaataaggtcgatttaatgcgtgaagaaagtgccttagaacaccaaaaatccatcttgaagttcatcagaggtaccattgctgacggtgctcctattgtaccaatatccgctcagttgaagtataacatcgacgcagttaatgaatttattgtcaagactattcccgtaccaccaagagattttatgatttctccaaggttaattgttattcgttcatttgatgttaataagccaggtgctgaaatcgaggacctgaaaggtggtgttgccggtggttctattttgaatggtgttttcaaattaggtgatgaaattgagattagaccaggtattgtcaccaaggatgataagggtaaaattcaatgtaaaccaatcttttctaacattgtctccttatttgccgaacaaaatgacttgaagtttgctgttcccggtggtctgattggtgttggtactaaagttgatcctaccttgtgtagagctgatcgtcttgtcggtcaagtcgtcggtgctaagggtcatttgccaaacatttatactgatatcgaaatcaactactttttgctacgtcgtctattaggtgtcaaaacagatggtcaaaagcaagccaaagtcagaaaattagagccaaatgaagttcttatggtcaacattggttctaccgctacgggggctcgtgtggttgccgttaaagctgatatggcaagattacagttaacgtcgcccgcttgtactgaaattaacgagaagattgctttgtcgagacgtatcgaaaagcattggcgtttgattggttgggcaaccattaaaaagggtactacattggaacccatcgcttaaggaaccaataaaaccactgcaaagacaaaaatttcataattaatctgaaagaaagtgaagataagaaacgggctaggaggaagggaaactgacacttctggttattgcaatatgctcatatacattgatgcgtaatgacattgatgatctttattctctttttataacgttttctttctttttttttccttcttacatagtattcaactgtatatttaacatgttttacgtatttttaagaaaaaattactaaacgcgataatattaagcaaatatttatctcatagttctcgaactcatttatttcccattgatgccatgaaaacctctcaaacctttatcgtctagttacaccagtagtcaataaactgcctttctttttttacacccaacatactctacactaaatcttatcggtggtttgtacatggagacaattgcacaaagataatgaagctccaaaattattcagtatctattgagtatatataaccttgaaaaggttttattttatataagttcgccatcttagtatagtggttagtacacatcgttgtggccgatgaaaccctggttcgattctaggagatggcatatttattttttatattcttaatatacaaagaatgtcgtgtgaagctgtaggcacaggtaattttgtaaccatagtcagatgtggtgatcatgagagcgaattataattttataccagctggcaagaattgagtaatatttagaccagcatataaaagtagaataaaaagttatatgtacaaattttttttgacgccaggcatgaacaaaaactactatggctttggaattttcaagctcttcgaaatcattccacacccatggataaaaaatactagaataattggatgaaattccaatatttggtcttctctaaaaatgccgaatgggatgttatcaaaaattaaaccctttctgacacaatatgccatacccaacaccaaagctagagtggttggcataggcaatccctcaaaatatttagatttacctgtgctagaatctttgggtaattgagcaacggtgacattaaaccttgctaatctcgctaagccgcaaaggacaaagaaagataaaatcatgacatcgaatgtagtttgaaatccaatggcaaaagcaattgcagccggagccacaccaaaggaaaccaagtcggccaaagagtccagttcttgacccattaaggaagacctatttctcagacgtgctactctcccgtcaaggaaatcgaaacacatacccaataaaataaagaaatgggcacgctggacgtaatgaggtttacctgtaagcgtaaatctcagacaacttacaatagagtaaaacccagaaaatccattcagcatagtaatgtaatctgccatatgcaaattcctcatcatgctgaaatgatgttcgtcacttgtaaatttttggatatcagtagcattagggggggccaatggagttgtatttatagaaaatatacttgaggcccttctgcttaatgtgccaccaacttcatctgaggcatacccgtcattttcgtctctgtgttcatttacgataacgtctgtgtccgtgtgtgggaattcttgaggtgcgaaatcttcatctgattcaaccattttttaatatatagttttatttttgttttttgattgaatcaaatagacaactaaaaatgacaatcacccacaaaatgaaaaaaataggtgtatctctctttccttatttataatgtttcctataaaatacggatcttcatctttagatgggtccatgtgaaagctcaaaggcgtgagggtgccgtgtgaacgttcaaagtgattttgaccaattactgatatatattcagtgtctggcacagaagtctgcacacattgagaaggagtggggattgatgttagggatatcttctataatgctactaatttatatatacatcccgtaacaattatgtgcatatacgtacgtacgtacgtatatacgtatatacattccaacccatatatacaaatacttacatgtagaccttgatatttagtatcatggagagctataatggaaaaatcgcagaaacatcttcgcttttatctaaaaagatgtagctataagctctataatcatatctattgcaatggtgtatacagtatttgggtcacgtatttttgtttatacctaacaatggatgcgacacataatgtattatgcttaatactgcttgtcgccagatggttcaatataacatggttcggaatgggaagggcgccagacgtattatcagtttgcgcgtttgagtaactattcaaaatgacgttttctaaatgaggtggcagttgtggaggagtcaaccaggccatattttggtgattattttgctgctgatcaagtgtcaaataatattgttccattacatttgggtcggtgaacacagcaggtatatcttgagtgtactctaaattaggtttagcgggggtctcatcgtgaaaacgagtgtaaccatcgcccatgtcatctggttccttttctatctccaatgcgattctcgagcgagcgctcataggtctcttactcaatttgctatcatctacatgattcgcttttttttcagccagatgctgctgaggttcattgccccaatcaggcggtgcgctcacttccatatagttgacgaagtttcccatttggtcggttgcggtaggtaaataatcactgaatcttaactcattgtcaacaataaatctgaaacgatgagtacctggaggcagctgtaattttacatgcataagtccaggctgtccagggactggtactaacccgatcatctttctccatcccgtaaaagacccagtaacgtacactttattacccccctgttgccaagtgatgtcaactggaaacatcatagctcttcctttcttgccttccacagtgccctgttgctgttcttgttgctgttgaaagccttgattttgaagtgagtcaggctgctgagatggttgataatccattttttgcaaggtatttcctgtcatatctgcatcgtggatatcgccttcgttgctgtcgatactactcgagctgctagcatcgatatcatcatcagaatcaaaggtctccccagaaccattttccgcatggtttgaatatggaggtatttcatcgtcatcatcgtcgttaaaaattaaactcgatttatgtcttaaaggatgctgaggctctaattcattaggattatctacgttcatttgagaaaaagtgtacgccagggaagcctcattagttgaatcggcgctatgtttaccattaatcgtagtgttgctagctgcgtcactgacatctaacatggaagcatccttgttttcagggttgtcgccagccatatttcagtgtagataatttattattgtgcaggaaacgaccttatacaaaatatagtagctcttatctaggatgctctctacttgcgattacaacagtggcccaaatcctacgagatcggtattgttttctttgccacgttttttcgtgagcttttccaaaggggagcaaattggtcgcttaaggatgaaaattagtgcaacaaaaaaaatagcgtggcctgtgttttaacggtaaagacaaattattgaaggtagagcaggactttgaaccggtccggatgaagaccactggaccatgtttcagtctcacatgggttttttgaagcacagcttttaaatttgcaatgattttctccaaaggttttctttgcgtcttcattccaggaaaaagtatatcaagtttcaagaacccattgttattttccttcttatattctatacgttttatttactgcttgtttatttactgaagtaagaaggagcactgttgaaattatcaatttgtcgcaaaatgctctttatcggaggcaatgatacattgggacttgtgttggatgctcttgattcttggcggtgaacgttactgtcctcatcatctccagatatatgaaattgtgccctttcatgttgtctccctctgctaacagcattaaccttgtacttatgattgctcctgcaagctttctgtgttacaggtggcctatcaaaaaatattcccatgcccatgtctttagccgcggtgtcatcatacgtaacagaagtgagtgatgatgaactgctcgaaacggatactgtccttgaaatttccatgtctcctgtgtttacagaaggcatgattcttcgcagaggacttaagtctgttggcggtcttgaaaagctctttgatggatgtgaagtttgagaaagaagcgaagcactggattggtttttagaactactcaaagaatcaggaccactcatggcggccaaattcctcctagatttcgaaaatatagaggagtttgaagacaattcacccagggctaaagaacttccggacgaatgtacatacggtgtagatgcaggatcttcaggaaacccgcttttcaggtactggaatggagaagtagagggatatactgatgcaatggaggtgatagaagtagtggagaggctacttggaatcggatgagggtcatttggaatatttatcacaggcactaaaattgcaggtgcctgtgtctccacaatgccattattatttccagtatttcgtatattcacgtcatcgcaattctgagcaacggagataagaataggtggcactttagattgacctatccccgtgagcgaaacaccagtgttttcattgaaggtggtaggggcggcggtagcagtattcacaacggtttttcgcgagcccttggattttattctgcgcctttggacgcctttagtatgtgtcctcaaatgtctttttagttcatcgcttcggctgaagcttttcggacagccctgaacggtacatttgtgaggcttctcgccagtgtgcgttcttccgtgcctttttttatgttcaagtctgtggaaacctcgtgaacaaatttcacatctaaagggtctttggtcattatccggaggaaatctatctcgcaggtaattcatatatggaatttaagaaaaggatcgccgatgtgcacctactaagagcaaaaggaaatactatgaagcacaccgactcatggcaagaaagggtctctgtttttaaactttatctactaggattaaggaaaaaaagaagaaaaataatgaagcaacaaaaaaaaactggaactgctttgccttccaagtattactgattgaagaacagtatgagggagctaaatcatttatacacggaaaaattagtgaaggattttttggtggggtctccaaggaagtaatttctacggtgtggtctatgtatgtttttccggacgcgttccgccgttttggtttctgccccagaacaccccccataaaagaggtttttccgaagagtgcctttcagtttttccgagatctttatctttttcatccgtattatgtaaacctgaatagccccttgagcaattgagttgcataatagcatgcaattgcatattgaacctcctaggacttaaaggttattcgtcaactaaggaaaaatatgctcataacttacatatctcgtacaccctaaaatcccacacagggattaaaattaaaattatgtttaggtaatgaaaaaatagtaaaaaaatgcttccttaagttaattatgaatttccctattaacacacatgcgtacacaaaaaaagtatacggaaactatattagactacactacatcaaccttattttcttttaaaacctggtgggggctgaaacttccttgtttgagggggcgcttcattattaaacctcgacctatttgcgccgatattatcgttgccaccattgtatctgctcgacgatggttgggcaatctccctagaattgctactagtatgcttcgcattggccgtgttaggtttagcgatctttcccggctttttctctttctcttttcttagtttcgtctgcttttgcgcttgtttcttttcctttttatctctcactagtctttccttcttggatagtagcggcttatcctccaccactgtggataagatctgttctcctcttagtatagtcagtcccaacactcttttttctaccttgatgttcaaagtggttccatcttttgaatcttttctcggtcttaatttatctagttgagttttgggtaccctctcttctatacactcattcaacactaaattcatatgtttatcaaatgccatcaattgcccgatgtaaacgcggccatcttgagtgagaaccctcagcttataatcaataaggttggctagtcggctgctatgtgccacctgtattttgctcattagttatttactttactggaaacctgttatacggatggttctgttaccccttctacttttttccctgtcttgttcatttctaactagcataggcttctttaaatttcattttttattttcataatttttattttgaattttttcccacattatcgtgagaaaaacaagaacatggagaaataaggaagctcggtgggtggttaattggggaacacacctggtaagtaaaattcaatacatggaaggaaagagagaaataatgtctgacgaagcaaaggaaaagcgtgaattagaaagccaaaaggaatcaagtcataataaatccgaaaagtctgtggaacctaagccaaagagaagaagaagaagaaactatgacgattatgacgctgaagtagcaaaagaggagactaaggctaaaaatggtttgacgaagagcgaaaataatggtactgttgaagattctgaatctgatatggacgatgccaagttagacgcattgatgggaaatgagggagaagaagaagaggacgatttggcagaaattgatacctctaatatcatcacatccggaagaagaacacgcggcaaagtaattgactataaaaagactgcagaagaattagacaagaaggaacctagcacaggctctaaagatgatgtaggatatggtgaaaaagaagaagacgatgaagacgaagaagacgatgattttaaagagtagtaagcaaaatgtcgtacataccggcctctacttgtgtattctgtttacttcaatttcctatatgcgttctatatgtatataaactatatgtcagcagaaaattgtaaaaatatagcacagaattaaaggggagaagagtcattcacatgcaagtgcgcaactgctgcaaaatatctcttaacaacagttatttccatttgcctttttgttttcgtttggtgttggtgtcagactaatcgttggtccattaggagcggacgcaccattggcattcccgttggcactggagtcaccaaggtccatttgatgcttgctgaccttttgatagatggtattgattaactcttcaaaagccttatccacgttttcactgttcaaagcacttgtttctgtgaataataactgattttcctgtgcaaaagtcttggactcctccgtaggtacagcacgtaaatgggccaaatcagacttgttaccgataagccccactgcgacgttgtcatctgcattttctcttaattctgataaccaatgattacaattttcatatgagcttgatttactgatatcgtaaacgatcaaggcacctacagctcctctataataagcagaagtaatggctctgtaacgttcctggcccgcagtatcccaaatctgcgccttgatcctcttgccatcaatttccaaagttctggtggcaaactcaaccccaattgtagactttgaatccatattgaattcgttcttcgtaaatcttgacaatagattggatttccctaccccggaatcaccgatcagtacaattttaaatagtaggtcgtaatcatacccgtagtcctcgctgctcattgttgaaatccccagacgccgtcagaatccctttgctggcctaaacaaagtgccttgtaataaaggtcaaattgttattcgtttctttcttgaaaagttttgagtttccctctttctctaatttagcacccgcacaccgcagcggcctgtgatattccgcattggaaaatggtaaacaaacaacaaacgagcccaaacataacaacagtagaattgacgcctaggaacaacaatacaacatacttacagcaagactactacctaattagtgcaattagattgcgctgggatagatctgaagctttttttccgattatgagcctccctgttacacctgtcaagagcaaagtgtgcagtacattatcgatacaacatgagatggaccatgatcaatgccgtgatgtgttgtgcccacgcgaaaacttactagccattaatagaactaataatatagagagtgttgctataccgcgacagagatcgagcaagaacaagaaaccccatgagcatacacaatcgcaggttcgattttccattccagatccaaatgaaatatcacaggactccccactgaaaattgtattccccaagagtggaaatgaaaccgaaagaagaatgtctacttcatcattacttatgaatagccatggtcatttagtcgacatgcactctaaaatactggtcgatgtccctaaagaagtttggaagtttcatcataacaggagaaaaaaatgtgaaagcaggcaccgtaaaactcgttctgatgttaggtccaacacaagtagtagtggaaaagaaccaaaccattctagatcaaaatcattacagtcgatcattgtggatacaatgaacacatatcgtgcaaccgaggttgagaccagtattaatgagaatactagtaatattagccaagtatctccgctgaatttatcatttgacaggcctcctcccttaactcccgaaaagaatttatatctcactcctgaatcgccattgaacagatatcatttaccagttccattagaaatatctctgccgccctacttatctccgcaaaacaaggataaaaagaggagtagcttggtttacgatggggatggctatagccagtttcaagaaggtaacacctcatcgtcaactgaatcttctctagaacagccctcatcgtcgtattcagatgaagatgattctattccatatgcccaccatgatgtgtctttcgagttaaataatgcagatgctgataagcttcttggaattgatgagaacgccaacgtcaatctgaagatacaaaggagaaatctcaaaaacccacaacatattaagagtaaaacagatagggaatgtgaggaaaaaaacactgaaaaaaatgtttcgttaaaaattctgtcaacaccaaataaactgatagacatccccgacttagagcacatgaaatccccaccaagcacaggtttaaatgggacattaaaatttttccagcagtttgaacctagcgaggagccaacttctccaactcgccaagttaaccctgaatcactggacaaactcgatatgtcattcaaatttccctccagtactactaacaataatgtggataaggtacatgaaaatagaaactctggagacacgaacaatgaagatttcctgaaagttgatacttcgcctgtgaatcaatcatttgaatccagaagacagatgttaatagacttgcaaaaatctccgacgaataataatccgaggatacataaacataggagaagcaggagcgttcataatattgatgacatttccttaaatttcgaggcaacctccacaccaccagctccgacctctgctccctcaattcctgttgaacattctaacccatgtacttccattgaaatacctaagagatcacccttacggttcacgtcatctccaaaaacatctgatattcctcctgaagctcaatcacctaaaaatgggtccttcctccaagaaatctcggtaccttcgattcaaattataccagatgaaagtatctctcatacaagagaaccatcaccatcacttattgaatgcccagaggatgaaaacgaagctttttctactgaagttgctgaccattctattgcaataattagtgaaacaaaaagtgttccatcgatagagccattcaaaccgctatcttcattcaattcatttggtcaagaaattcaaaacaaggaaccaactcctttgaaccaaactcctacagacttaattggtaaacaaagaaactgtgtgaatccgcattcaattccatttagtgttttatcttccaatagccaatcgtcacaatcgggtagtagtaaatcttcctacaattctgagttttcttccaatactgccattacggatacaacatctcaaccttctgtgaccattaacaggtcaactttagaacataactttatagaagaaaaacgatcaattaaaaatttaggtcatggtcctccatcccagaagaacaactattcgttccccaggaataagaatactccttcaaatagacacgatttggattttaataccatttacgaaaaaagagatggtaaaatggttgaggttattcttttagatgaggatgaagatgtaggcctcaaaaataacgatatatcacgaacaagagtctgccatgctcaaaaagctaaaaatgagcaacagaagaaacgtctaagccattgcaacgaaattttgggcatgtgtgataaaactgcagatgatgcaaaaagaattatttatcaactggtaaatgagaagcataaattctcagaaaaaggacaacaaacaaagccaaaaaaatcaagagtacttccgccgttgccttttccactgtatgatgaaaaagggaattctttgatcccgaacaagtatcagtccagtattcataacgacattccatctcatcgcaaactaaaataaaaaaaaaaaaaacaaccctacaaattgttctggtaaacagatttgaccagctcatcgcatgaagatttatcggaatggcaatttgcttattgcctattttattttttcatcggacattacaaaatttcatatctcttacatgtaagaaaaacttctagtttttgtactttcttaaaaaaactatattcagacatgccaattctgtaaaacaaattaataatatgtacttttatatctaccaaagatcatccttggcacatgcaattgattacaaatacgaacattacgcaaaggttttaaagctagtcacctactagggaagaaatgtggaggctacgggcataaaaaacatgcagtattttctcacgctctctttggcgagctttgaacagaagatggtgtctcctgaatagggcttaatgagtagtcatttgagaactccggtgtgggtttagtaaatgaattagttggtgtgatagttgtcggtaaatttggtgagattacgtagttatcattgcattttccatctaaaccattcgatatttgatgttgtggcgaaagaacacttgaaggttctacgttttgaccaacattatgattttgatatttactatctctcatttgggatgaagtttttcgggagagtgaattgcagtcataagtattccaattattactgttaaagaaggtgacagtcttgtttgtaagttcaatcttatttttcatcggagctaattctttagccccttggttgatcgttaatttcccattaaaactatgcgtacttctgaaagacgatgacacagatgaaaaaggagagacttctctattcttggagccgccccgtaaaggagatttcagtgtacgacgattaagatcatctctttcagaatcagagaagttaaaatcctctggaatgccattaatttcatcgatgtcgtagtggtcgaaatcaaaaaacttacttttctgattgtattcgtcttcctcagcttcatcaatgaaaaagagattactcattggtctggggacttctgaatctaaatcgcaatttaagtcatgatattttagtgattgagacctagctggcggcggaagaggggggctattgagtacagccgtatactgtgggctcgcatagtgcggctgctgtgaatgagaggaatcaataagttgaaacggagttcttagtatgctactagtgtcatcatcatcatcttcaccatcatcatcggtgattgcaagggcttgtgattgcgcatcagaaacgcttggagttattacaatcttagccggtgtttgaagaatctgcgaatgaggatgattgggaggatgggattctgatttggtttcatacaaagaactttgcagggagacctgcctttctgaatcattggatactaagccgttagaattgttccctcctgtcccagaatcactttcagcgtcacttgcactatcatcaacattaaatatatctgaaaacgactttactgtaggcttggtagagccagtagtacctgtaagggaagcctttattgcagaagtgtgctccgtttcatcatccgaattattccttttgagagagaaactatagttcggctttccatcacgtatgatatttttgttagattgactatagatcccccgtgttgattttgcatttgctggtccactttctatactaggagcttcatcggaaaacatataagactcagcttctgacatctctttgtcgtcgttatcgtcctcatcagacaaatcgaaaaggtcattgtatttttgaataggcttcttgacattatcgtttattagaaactgctctttgttgtcaaccgtttctccaagagatgcatcatcatggtgtccgccatggttaccattaaaagtttctttcccgttttctaatcgtttttgataaagattatcactctcattttcatctccattgttactgttatctttaccatcctcctcctcatcatcatcgctcaagttaaaaagatcattgaactttttgactttattgcttttcaaggatgtttcttcgaatcgagtcgataaaccgcatatttcgtttccctcattaccactctcatcatcttctatacaattcatatcgtcatcaaagttctcatcctcatatagatcgtctatgtatacatttgccgccggttccggtttggagtaatactttacagatgatgtccttacgtttatgccggcatattcaaacgaaaattccgactcatcatcatcatcatcgtcatcatcatcgtcatcataatcatcatcatgatcattatcgccatcaccgttttcagaagattcgtcattacaatcgttggctttatgggtttctttttcattgacagagtattcatcggaattgttgttgagggaatacaccttttcttcttcttttctattaagactaatccttacttttttcttgttcaaggtctcgttttgactatcgtttttgttcacttttgaaggtgatgattgtaagtcgccgtgtcgtatctttggtgagagggaaagtgtttgactataaaaacaaggtgacttgtttattggtgatgtggtttcggaagaggttaaagtggaagtagtggtcactctttcgatgtctaatattttctcatcggtttgttcattagaagattggtcattattaatggtggtggttgaatttccggaaaacgcagcggctagtagactcatatccatttgagaagcctttcccaaatttattatatcatcatgagaatgaattcttgcttgtctgtttctatttttggcaagcgctaatgctttataaacatgatgttccttcttagatgacccgtcctcagcatcgtcgatattttcctgctgtttacccttgttcttgttcaatattcttatggcaggttccaggttagatggtgatgtagttgaagttagattttcattgccaatgataggggttttgaattgtttagaagaagtcgcttcagatgtgtttgatgctggggaagcaggatcgtttaatattattacgtgcgattcgaccttggaatctccccacgaatgagtaattgtgcccttaatagcaggcagagagtctgtggttctattaaaatcttttgcaggagaagtttttttatatgcagtatattcactttcattgtcatgacgtgaaaaggaagaggtagaagaggaaggaaagagcggcggtggtaatggcggcggaggtccagtattttttgtgggtggattttggagaacaaatgaatttgaagtagtctgatttgtgcttgtggttggagttgaagctaaatgcgagtttaagtttgagtttgaagttttcttgaacaactttgaagtcttgttagccaaacgatggaaagactcaaatccaggtgagtgtttcgcgggtggtggaatgctatcgtaattcatttgtgatggtgtagatggtagaaagtctaaggagtcatcacttgacctttgagaactattattagtattgccactgaagttgctatgtcgcttggggctttcatcaaacgacgtggacttcttatgggcttttatgaaagaccgcatgatgaaatattccagttatgcgtgtgcgtcttgtgatgcagatccttttgggcaaaaacagttggtttgtgcgaaaacgcaaggtaataaataggcttaaaggaactaaaaaaaaaaaaaggaaaataaccagctaagatttaaggtacaagaaagcggttgcacctcaagtaatgatagttattaaaccttggattggaccagatgtttaaaattgttttcaatagtagatttgcagtcgtaaatgcgttctcagcaatatcatattgtgtttatgaagtattaccaaacgggtagaagaacggtttaagagaatatgtccggataaagcgatcaggagaaaagcttaaaacccaaagtggtcaatctgcagcccatttaggcactctgcatttaaccgatacccggattgaagaaagctggcgggtgtatgggtgaaggagaagaaaggaagtgattaggagaaacctcatggagatgagcacatgctacaactaataacgttattctacttaaaacgagcaaaacaaaaaaaaaaacaagacaattgaaaacgcaatggatgcattcagcttaaagaaggataatcgaaaaaaatttcaagataaacagaaattgaaaagaaaacatgccacacccagtgatagaaagtaccggctattgaaccgccaaaaagaagagaaagctaccacagaggagaaagatcaagaccaagaacagcccgccctgaagtcaaacgaggacaggtactatgaggacccggtactcgaggacccgcattctgcagtcgccaatgcagagttgaacaaggtgctaaaagacgtcctcaaaaatcggctccagcagaacgacgacgccacagccgtcaataatgttgctaataaagatactttgaaaatcaaagacctcaagcagatgaatacggatgagctcaatcgttggctcggacggcagaatacaacatcggctataacagcggctgagcccgaatcattagtcgttcccattcacgtacaaggtgatcatgatcgtgcgggcaagaagatcagtgccccttcgaccgatctaccggaagaactagagaccgatcaggatttccttgatggactgctctaatcgcgcggtacgacagttactgcgtgaaaagattatcagcgcccctttttttcttctttgttcttaacgtttctttttcttgcggcttatgcccgtacttataaaacaacggcctcccgtgccctattaccttcctgatagaccggacaataacgtcactacatacaaagttatacactaacagaaactcaaacacaaacgtttttataatagtcaaaattaaatatctctcataatgggttccgagacaaaacattctgcaaaagtcaagattgtcacaagggaaagtcctccttccgccaaggagcacatgcgccccactaaaactcaaatattagttccaccgacgcagagtttgcccaatggcaagaaaccaaacttcggtaagtctacaaaacagcggcgagaacctagggaacgcacctcgaagacgggacacgaggacgataaggcaacgatggtcactgttaacatagatgccttcctacatgataaggcccctaaaaaaaaatcgtgcaaatacaagaagaagaaaacgagacagtaccaggatagggcggcggcgtcgatcgattcgaaaccgcacgtagctggtcatacggcctttgccggtgcttcgttcacaacagatatcccacatgaggcagcgctacccaaacctagttttgtttgagtagctgtgattgtaaatttttttatttctacttgagcgggcgggctctcatttttttttttggggttttatttaggtcggattattcataaagatggcatttatatacatttttacgcaattaccctcatattcttacacatacggagaagtcattgttatatcttcttgccttcacattgttatcggtgattttctttctttattgattgattagttatataaattattgctattaaaatacataaaaggggaagtaaaaacgtgcacggcgcagatcaacttcacaattacaaaacaacgttcttggccaatttgttcttatattgcaaaatggatccgtcccatctggtagcggtcttgttttccacaacgaaaatatcttgggcaattttgtctaataatctgaaatcatgcgaaacgacgacgacaccaccgttaaattcgttgatggcgtcggccaaggagtcgatggttgggatatccaaaccattggtaggttcatctaatagtaggacatttggttgttctaaagctaataaagcaaagacgacacgagaacgttgaccttctgacaaggtagccatttgaacggtttgaccttccccggttagcccgtagcgacctagttggcctctccagaattggaaatcttgtgagatgttagagtacttgtcacggacaaattctaaagcagattttgtcaagtccagttgatcttgagagtgttgcgagtagacacccaacttgacatgggtatgtctagaaacacggccagattgtggggtcaattcaccggtcataatcttcaacaatgtggatttaccaacaccatttggtccgacaagggcaatacgtgagtccatatcgacaccaaagttcaaatgttcgtacaagttttcggatgggttgctctcataatgaaatgaaatatcatcgaatgctaaaactggtggtggcaatctttccacttgtgggaatctaaatgagaaaactttgtcagggacgacaggttggactaaaccatctgcttccatcttgtccaaaattttttgtctagatttagcttgtttcaccaagttagcataagtaccagcagatgcaatgaattttttaatatgttggatttcctcttgttgtttattgtattgtttcatttgattggtttccaattcggatcttgtcttgtgataagaatcatagttaccaccgtaagcagttagtttttgagctctcatgtcaatcatattggtacaaacaccgttcaagaaatcttgagagtgggacaccaaaactaaagttctgtcaaatctcttcaaatattcttctaaccaaacacaagcttccaaatccagatgcgcagtaggatcatccaacaataatagagttggcttaacgaaaagagcttttgccaacgcaacacgcattttccatccaccagacatatctttggttttcttcaaaatggtcttcttgttgaaacctagaccgatcaaaatgatagcagctctagattcaaaggtgtctggatccaaagagtccattctttcatatagaggctctaataactcggactcaggaccatcttccaagatagtcttttcgactaagtcttctattcttttcaattcgtgttgagcttcagtgacaacgtagtccaaggccgacaattcacttggttccgcaggttcgtccaataaataaatatcaatatgctcaggaataggatattctctagtagcaagagcctttaagaatgttgacttaccacaaccattttctcccagaagaccatatctacggccgtagtttaattctaaaccagaatcttggatcaaaactttaccgtggaacagtaaagaaacagaagatagcttgatatcacgggaagtctccaatgaactcaaaacaccagtgacaacacgatctgaaagaccatccttatcttgttgcaacttcatcatcttgatttctctagcggctgcatctacctccgattcttcagcagcagcctccttttttctacctagctttctgatggttttaccggcagcggctttcttagcctctctttcagctttcttagcatctctcttggcctttgacgcagatactggtggcatatttggttctgtcaagttactgtttgtagcactgaggggaagaaaacaatttttgcaagaaaaaagttaagaaagaagaagaaaaactacacgggcactaacatgttaaatatgataatatttttttttataagagaatcactaccaagttacctgaactacgtcaaggaaaagccattaattgagatgaggtgaacgaagaaaaaaaaaaagaaaaaaatttttatttttttttccatcggtctcccccctcacctttcttttttcattcgtttaaagtgagattagggtaatgcatttcgtatttagtgagtaaacgtcaaaggtgatatagggggtttttctttttccagaaaaagaaagaaaaaagccggcggtcgccgccggagatggttgagaaaaaaagggggcagcaacgtgcttcacatacaaaccaagttcttggatctgtacgatcgtttctgcgggtttttccgtatttgccgcaatactgaaatggctcattattaggagatgtgcatataatgtatatacatacatttagcatatgtaatacattcgtacatgtatagaaatatatgtttatatatatatatatatatatatgtatatacgaactcggtttaacgcatagttggtaaaagatttaatgtagataaaaaacacataagttttatacgcacgtaatcatgactatcgctaaagattacagaacaatttatagaaaccaaatcaaaaagcagatacgactaaatcaggagcatttgcaaagcttgacacatctaggctcacaaatcaatttcgaggtggatcctcccaaattaccggatccggatcctgctcgaaaagtatttttctttgatatcgataacactttgtacagaaaatctacgaaggtacaattgctcatgcaacaatcattatcaaatttctttaaatacgaattggggtttgacgacgatgaggcagaacgcctaatcgaatcgtattatcaagaatatggattatccgtgaaaggtttaataaagaataaacaaattgatgacgtcctacaatataatacattcatcgatgattccttacctttgcaagactatttaaagcctgattggaagttaagggagctgctgatcaatttaaagaaaaagaagctcggcaaatttgacaaactatggctgtttacaaactcgtacaaaaatcatgccatcagatgtgttaaaatattaggtattgctgatctatttgacggcataacctattgccactacgacagacccatcgaggaagaattcatttgcaagccagatccaaaattcttcgaaacagctaaattgcaaagtgggttgtcgagctttgcaaatgcctggtttattgatgacaacgaaagcaatgtgcggagcgcgttgagcatggggatgggccatgttatccatttgatagaggattaccaatatgagtcagaaaatattgttactaaggaccacaaaaataagcaacaattttccatattgaaagatatccttgagattccattgataatggacgttgaagtttaccgtccatcctctattgccataaaggaaatggaagagttggaagaggaaggggaagcagtcaactggtcaaatcaacagatcaatgttcagtcatcatgactgttacctgattttagaaaacaaatttaatattcccttcaggatagaaatttcaacatcatttgtcgtttcattagaaatatccaaaatacaatctttgaaatattctgttacttgacatttgggaccaaaaggaataaatttcgagccatacatcgttaaaataaaatatagtagatttttatagtttttacaatcaaaaaattcgttaaactctttgattatattttgctgtatagtttcagtccgaccttgcttttcactaaagcgtctcctgagcaaggcgctttgtaaatgagggaagatttgtagtagcctataatgtaaaaaaaagtcgttcttgtccacaatttcgaaatatgaatttatgaaatgtgcctcattaaataattccaggaccttaaaacacagtctatggtccgattccatagcgttaaaaacctttctatccaagattaaacatatgaaggctttcagaaagaattctctaacatcatcattatcatcatcactataaaaatacattaggaatttgagcattttgttaacggggaaaattgtgcataaattatcatatctagaattttcctttttctcgtagttgatttttaacgagttacacttttcttgattgacgccaaataagaccagtaaattcgtgatgcttgggcatttcaagtgaacaaattcaggaacttttccttgcgatctactactaccaaacaggaatgaatacgccgtatctttcatttccaaatccatcaattgctcgtaatggcagtttttagagatgaaatgccaatctttatatttatctgatatggtttccttggtaaccacatccaaataaatttctgggatagacccagaaaactttatgcttttttgtaactcacttttggctacagtgttactagtaataactatgcttttgttgcttctaggtgaatccaatatttcttttttcaagtcttgtagcttggccactgtagtagtgatcgtatcgtcgaagctatcacctagattgaaaatttttaaaggtacgtaattgactaattttctgggtgtcttgacaatctcctcatcctcgttattacttggtgcctttcttttggaaatgatggttctttttaagattggatcaaaatcgtctccagactccgccttggcaccagaaagattcaaatcgctgttctctaggctagaaaactcttcgtcgctattcaaactgtcgttctcaggatcactaataaagttgggatgcaccttctcatcgtcatcgtcatcgcgaaagtaacttcccacactagtcggtatcaaaggagaatcaaaccctgaaatttgtgaatctggcacagtttcaaactcttcattcggtgatgagttcacgcttcccatttgtgacactgcccttttgtgcgtctaacaaaattttatcactttattgctatttacttgaaaaattatatatgaatatatttcataaaacgatgctgacataatatgtaacataaaaaaaggaataacctaaaacaaatacaaagaagaccccatataaatgaatataaatgtatattttgcttgagcaaatgaagaatgtactacttctcaagagtagctgctagaactttttgctgttgtatctttttctgtttagccacagcgtacagcaggccagacagaaatcctagaaagatagaaaagaaggacaaaaagttttttggagcgtcaaagaacaccaatcccgccaacgctatgggcaatttgttcaaagcaccaaccatagaatacgttgtagaggaagttacacgaacacaccagccggaacagtacgatatccccacggacatgagcccactgatgaccattgctgccagtgagtcggcggacaagttcacagacaaattctttgtggaccaatcttccataatgaaggaaaagactagcagcaaaggcaatgccagaacgttgttataaaacatagtatcatagtctttaaagttagtcagccgaattctcttccgcataatcaaaacgaacaatgcagacgaaatacaattggtgaacatccagaggtaccccggattcaacacaaagatggttgactcaacaagttcctgatcgagatcctccaaagatgatgctttgattgcaatggcctgctgatcgccccaggtggccactacagatgaaaggaccatcataataaatgacgtcaactccatagaagtgacttttccgccaaagaagaggacctcgccataagcaatgagaatgatcgtcagattcttgaaaattgtgtagatgggcacggcaaggtattgtaagctctttgacgacgtataaatcatcaatacgagcagcaaagaaattggaaaccagttttttacatctgtcctgttcaaagatcaaaaattagcaacgcctacaattcgtaggatacatagcgtcacagtgcacaccagtgattgtacaaacaacatcacaaagttcatgttaaagttgtccaggttaaccacgaatttgttcgttactgtcatcaaaatcgaggacgcgcagtaagataagattgaagccggcccagagttggccactgattccgtccattcatgcttatgcttgctcataattaccacaccttcttgatctctttacagcttttcaaccttccattcttgtactctatctctacctggccctttaaacattcttaatatgatatattcacattttttgctctattacccggcggacaggttcccgaaagaaagtgacatggcaatgctgagagagtggaaagagtcatcttgcaagacagagaaagatgttcaagagtggtaagctaatgtcagcgcagtagcccatcccacaataacagagtgtgtaagaaagagagacgagagagagcacagggcccccttttcccccaccaacaaacaaatgcaagacgaccccgaaaattcgaagctgtacgacctgctgaatagtcatctggacgtgcatggtcgaagtaatgaagagccgagacaaactggtgacagtaggagccagagtagtggcaacaccggtgaaaacgaggaggatatagcatttgccagtggattaaacggcggcacattcgactcaatgctggaggcactgcccgatgatttatattttacggacttcgtgtctccttttacagcagctgccacgaccagcgtgactactaagacggtcaaggacaccacaccagctaccaatcatatggatgatgatattgcgatgtttgattcacttgccacaactcagcccatcgacatagccgcatccaaccaacaaaatggtgaaattgcacaactttgggactttaacgtggaccaattcaacatgacgcccagcaactcgagcggttcagctactattagtgctcctaacagctttacttccgacataccgcaatacaaccacggttccctcggcaacagcgtctccaaatcctcactgttcccgtataattccagcacgtccaacagcaacatcaaccagccatctatcaataacaactcaaatactaatgcgcagtcccaccattccttcaacatctacaaactacaaaacaacaactcatcttcatccgctatgaacattaccaataataataatagcaacaatagtaatatccagcatccttttctgaagaagagcgattcgataggattatcttcatccaacacaacaaattctgtaagaaaaaactcacttatcaagccaatgtcgtccacgtccctggccaatttcaaaagagctgcctcagtatcttccagtatatccaatatggaaccatcaggacaaaataaaaaacctctgatacaatgtttcaattgtaaaactttcaagacaccgctttggaggagaagcccagaggggaatactctttgcaatgcctgcggtcttttccagaaattacatggtaccatgaggccattatccttaaaatcggacgttatcaaaaagaggatttcaaagaagagagccaaacaaacggacccaaacattgcacaaaatactccaagtgcacctgcaactgcctcaacttcagtaaccactacaaatgctaaacccatacgatcgaggaaaaaatcactacaacaaaactctttatctagagtgatacctgaagaaatcattagagacaacatcggtaatactaataatatccttaatgtaaataggggaggctataacttcaactcagtcccctccccggtcctcatgaacagccaatcgtataatagtagtaacgcaaattttaatggagcaagcaatgcaaatttgaattctaataacttaatgcgtcacaattcgaacactgttactcctaattttagaaggtcttcaagacgaagtagtacttcatcgaacacctcaagttccagtaaatcttcatccagatctgttgttccgatattaccaaaaccttcacctaatagcgctaattcacagcagttcaacatgaacatgaacctaatgaacacaacaaataatgtaagtgcaggaaatagtgtcgcatcctcaccaagaattatatcgtccgcaaactttaactcaaatagtcctctacagcagaatctattatcaaattctttccaacgtcaaggaatgaatataccaagaagaaagatgtcgcgcaatgcatcgtactcctcatcgtttatggctgcgtctttgcaacaactgcacgaacagcaacaagtggacgtgaattccaacacaaacacgaattcgaatagacagaattggaattcaagcaatagcgtttcaacaaattcaagatcatcaaattttgtctctcaaaagccaaattttgatatttttaatactcctgtagattcaccgagtgtctcaagaccttcttcaagaaaatcacatacctcattgttatcacaacaattgcagaactcggagtcgaattcgtttatctcaaatcacaaatttaacaatagattatcaagtgactctacttcacctataaaatatgaagcagatgtgagtgcaggcggaaagatcagtgaggataattccacaaaaggatcttctaaagaaagttcagcaattgctgacgaattggattggttaaaatttggtatatgaccgcgtattatcattatcattattcttattatgttaataattactgaacggttgcattgatagattttcattacctctgaccacaatcctgagcattggtattatttgttttgctattttcagatcaaattacttgtaaaaaaagaaatggtagtatattggcattgaacactggctgttctatttgtattacttttatgtgtagacatatattattaggaatttgtaatatcactctaattattatttggtattctttctctatctcccctgtttcttttgtctatctctttcttttttttttttaaacggcccttttttaatggcattttctttttcttataatgcccacagttgaataatttaactagcttttgactgacacataaacaataatgtatatggtccatccaatgaaatgacagttctattgcattttacctacttgtatattctggatactgcacaagaaaatgggtgtctcacaaatatgggaatttttgaagccatatctgcaagattccagaattccgttgagaaagtttgtcatagactttaataaatcgcaaaaaagagctccaagaatcgcgattgacgcatatggatggctatttgagtgtggatttatccaaaatatagatataagccccagatctagatcaagatcaaggagtcctacccgttctccgcgtgatagtgatatcgacagtagtcaagaatattatggtagcagaagttatacaactacaggaaaagctgtgataaacttcatatctcgattaaaagaactactgagtttaaacgtcgaattcttgcttgtatttgacggagttatgaaaccctctttcaaaaggaaatttaaccacgaacagaacgctactacttgtgatgatgagaaagagtactattcaagctgggaacagcatgttaagaatcatgaagtttatggcaattgtaaaggattgctagcgccatctgaccctgagttcatcagtcttgtacggaaattattagacttgatgaacatttcatatgtaatcgcatgtggggagggagaagcccagtgtgtttggctgcaagtttctggggctgtagatttcattttaagtaacgattcagatactctcgtatttgggggagaaaaaatcctgaaaaattactcgaaattctacgatgattttggcccaagttcaataacttcccacagtcccagtagacatcatgatagtaaagaatcttttgttactgttatagatctacccaaaattaataaagtagcagggaagaagtttgatcgcctgtctctcttatttttcagcgtgctattaggtgccgattacaatcgtggagtcaagggtttgggtaaaaacaaatctttgcagttggctcaatgcgaagatcctaacttttccatggaattttatgacattttcaaagatttcaatttagaagatttgacatcagaaagtctgaggaagtctcggtatagattgtttcaaaaaagattatatttatactgcaaggatcattctgtcgagctatttggaagaaattatcctgttttattgaatcaaggttcatttgaaggctggccatcaactgtcgcaatcatgcactattttcaccccattgtccaaccatattttgatgaagaagttctcagtgataaatacataaatatggctggaaacggacactacagaaacttaaatttcaatgaactgaaatattttttacaaagtttgaatttgcctcaaatttctagcttcgacaagtggtttcatgattctatgcacgagatgtttctattaagagaatttttatcaattgatgagtccgataatataggtaaaggtaatatgaggattaccgaagaaaaaattatgaacatagatggtggaaagttccaaataccatgttttaaaatacggtatacaacattcttgcctaatatacccatttcttctcaatctcctttgaagcgcagtaattctcccagtagaagcaagagtcccacacgacgtcagatggatataatggaacacccaaatagtctttggttacccaaatacttgatacctcaatcgcatccattagtaattcaatattatgagacacagcaacttatacagaaagaaaaagagaagaaaggtaaaaaatcgaataagtctcggctaccacagaagaataacttggatgagtttttaagaaagcatacttcgccgattaaaagtatcggaaaggtaggcgagtcgagaaaggaaatcctggaacctgtgagaaaaaggctttttgtagatacagacgaagatactagtctggaagaaataccggctcccacaagactgaccaccgtcgatgaacacagcgataatgacgatgattcgttgatttttgtagatgagattacaaacagccaaagcgttttagatagttcacccggtaaaagaattcgggatcttacacaggacgaacaggttgacgtttggaaggacgtaatagaaatatcaccaataaaaaagtcaagaactactaatgctgagaaaaatccgcctgagtctggtttaaaatcacgctcaagcatcacaatcaatgctcgccttcaaggtactaagatgttgcctccaaacttgactgctccaaggttagaaagagaacactcctctgtccttgaccaacttgtcacagacgcacaagatacagtcgaccggtttgtagcctgtgacagtgatagcagtagcactattgaatgagttaacgggcacagcgtcaaaaaatccgccaccacagttgatcgcgccgaaaacgagggagttgcgatgagtaaaatgaagggcatatataaacaagagtagacagagacacatttttcaatatcatatatatagatttaattggaaagacagttatattctaacgtcaaaaacttaacaagtaaatcaagttgcaatgtcgtcgcttatttcaaaaaccattaagtatgatccagccaaggataaattaatcacattagcatgtggatgtttttggggtacagaacatatgtataggaagtatttgaatgaccgtatagtggattgtaaagtaggttacgctaatggagaagagtctaaaaaggatagcccctctagtgtctcttataagagagtttgtggtggtgacacagattttgcggaggttttacaagtatcctataatcccaaagtgataactttgagagaattaactgatttcttttttagaatccatgatcctactacatctaattcacaaggacctgataaaggtacacagtatcgcagtggattgttcgctcattcagatgctgatttaaaagaattagccaaaataaaggaagaatggcaaccaaaatggggtaataagattgccacagttattgaaccaatcaagaacttttacgatgctgaagaataccaccagttatatttagataagaatccacagggatatgcatgccctactcattatctgagagaaatgtagcttttttagtgtacgtgcccttatttatgaaaaaaagtcaagtgcatgaatgaaatatttactgttgaagaatttattatatatataggtatacaggatctatcttttcgataacgtaacttagtatcacatgtattagtattaatactgtgataggattgttagctgttgtttttatatttgcaatttatttatgatcttttttgatgatcaaaccgttgagtttttgaacattaaaaaatagtgagaaagaagaactgaaatgggaattgaattgatcaatatctgtagtggtcggccttgaatggaccttcttctggaatacccaagtattcagattggactttactcaatttagtcaatctaacacccaagttgcccaagtggaacttagcgacagcttcatccaagatctttggcaaaacgtggacaccaacttcgaatgggcctgtcttttggaattcaatgtgcttttctctgaaagacttatcgttagacttgaacaaagcaatttgagctaagacttggttagagaaggaacaagacataacgaaagatgagtgaccagtagcacaacccaagttaactaatctaccgttagccaacaagatgacgtgtctaccagaagacaacaagtaacggtcgacttgtggtttgatgttaatacattctttagcgttagcctttaaccaggcgacatcaatttcgatatcgaaatggccaatgttacaaacaatggcatcttctggcatgttgatgaaatgttcaccgttgataatatctctacaaccagtggtggtaacgaaaacttgaccaatgtgggatgcatcttccatggtaacaacttggtagccttccatggcagcttgtaaagcgttgattgggtcaatttcggtaaccaagacacgagcacccattcctcttaaggcagcagcacaacccttaccgacatcaccgtaaccagcaacaacggcaaccttaccagccaacatgacatcagtggctctcttaataccgtcgactaaggattctctacagccgtacaagttgtcaaacttggacttagtgacggagtcgttaacgttaatggcaggaacctttaacttgccttctttgaccattctgtataagtggtgaacaccggtggtagtttcttcggaaagaccaaagcagtcttccagcatttcagggtgcttttcatgaactaaagtggttaaatcaccaccatcatctaagatcaagttcaatttcttgttgtccttgaaggcaaacaattgttgttcaatacaccacaaatactcttcttcagtttcacccttccaggcaaaaactggaacaccggaagcggcaatagcagcggcggcatgatcttgagtcgaatagatgttacaagaggaccaggtaacttcggcacccaaagcaactaaagtttcaattaaaacagcagtttgaatggtcatgtgcaaacaaccagcaatacgggcgcctttcaaaggttggacgtcaccgtaagcctttctgatggccatcaaacctggcatttcatgttcagccaattcgatttcctttctaccgaaggcagccaaagagatatcagcgattttgtagttttgagctggagcagacattgggaattgttctttttgtcagttgggttatttcgaggagaagaggattttcagaaagaaagaaaaacaaataggaatggaatcatggagttaataaaccacgttactaaataagagattggaaaatctaaaatacggcttcgaggtcgtttaattttctttttcctctgaaaattttctttctttttcggccttagcctgtgaaaatttcggccgaaaaaaaagccaacgagatcacgtgcacagaaatatctgcgttagaggagagaggtagggatacttacagaaatgaagccaaattggcagctttttgagaaataatcatgaatgataaacaattgctgttaaataatgtacggaaggtttggataaaggttgctataggcattatataaataaatcatctctatataattttttttacaggatatgcttgcccttacatcagaattaccaagcaacaccagtgtagtattctctttgtttgtacatccaaaccaaagaggtggttgagacaaccaatggacccatgaatccctttcccaacttacaagttctaaagatcaataattcagagccgaagtggaatagggcaaccatataagacatgaagaccaattcgaaaatgtgtggttcattcaagtacatagccccatagaatctgataacacaggaaataaaggtccaagtaccgaaagttcttgcactcaaatgggttgtttcagtgggttttctttcgtagactttacgtgtcaattctaaaccagaaacgtaagtctggatagaattgaagactgatacaatggaaatgaaaagtaaccattttggtaagtaaccttttggcattgctgccaaggtggtcttggttgtagttattacgtcttgtaggctgaacattatctgatactttagtgtatttgaatccttcgatactatggtctagctagtgtcaagaatataaaaacctgaaattagtcaatgcgtttacgtcaaaaatagtagcaatagtaaagcaaaacaacaggcttgttcagcttagttttatatacgggggtagagaatacaatggatcgtacctttttttttgtttcctgttcgttccgtccccgaacgaaaaaatcataaaatagaagtttcctatcggtaataccgtaaagtttaattcagttcgtataagattaggttaatcatgggcaagtccggaagaagcgttttaatgtaggtctgttggggaagatgttgtgttcactgtaattttcaactgaagttgttgtccccgaaatgaaagagctttcgatatttttgtgttttataatgcgcctcctactgcaaaagaaaaattaaatgttttctgtctcattgaaccatcttgacaatcgaaagcgcgctatcaaatttctttcggcagtaattaataaggccgcctgtatatatttccttttcttctgaagcgatatttcatgagccggaaatttttccaggaaaggttttaagtgctgccattcaatgctttcaaatgtctcgagcaatgatagaataactatcttgagtattttcaatagaccccctaactctttttctgggacaccgcttattacactgtaaaagttctttaagtaggttttcttcaaactcaattctctttcgaggtatactcgacagtacgcctttttccggttgatgcatattagtttatgcttcgatacaaatctaataagtacatgtatcagactttcgatgatgataagtatgtgttcaattaatttcagaacagatacgtattttaatatctgcggttcaaatgtttggtttgtcttgattttgatgagttgaatgttaataatagagtaaataagggtaaaatgcaacgaacacaagcgcttgtagtcaactttatcacataaatgtttgccatctccctggtcgtaaaagttttgaagccattttggatcgttttggttcttcttcaataaaattctattaaacagaaacttggcgatgaaattgaaaacatgaacgtctatcagtgtcctcttaaaagaagaatcagaatctatgcgatgcgaataatgagaaactaacaagatttggagtgtttgaaacacttgcgataaccctctaaagtcaatttcttttgtttttaagctcaggatttttagcagaattttatatctcggtaaaaaccagttgtttatatcagcagttgatacatctttgctaaatgattgcagctcctttaaaccaactgcatcttcgaagcttttgtacttattctggcaaaggaaattgtatataggttccagatgagcaaacagtgatttattattcaaaaatccattttcgaaaggcgcaacccatttgtatatatgttttgagttttcccgaggatttatttttaaatttttttcactcttgagagcacctacatcttcgacatctcctttctttcttgaaagtgccctcttccacaacgtaggattcctggattgaattaaagcaaaacactgtcatagataatattcgaggagattacacctcttactaaaagttagtaaagagaaaataggttaaggatgtgacaatttcacgtacgattatccagtcaacttccgatgtttccttttgttccatatcttccagtttgcctctactcatgtccttactcttctaaaagattatttaatgaaactgtttcacaactacaagatgtttgttatgttttcttttacaagtcggaaacatttagccgcccagcaatatatatgactccgaaagaaaatgaaaggaaatacatacatagtaaaataaatcgtttaaacataaataatcgtacagaggaaaacattaaggaaggagagtcaaactaatgtactgggaatttggatctcccataagaagtatgcgcaatacttttattcatcatatagactggagctgcgtatcatttcttcaatcattttcagaaacccgttaacatcactatccttgttttgaaggctttgataactattattaccaccattaattgtgcattcttgcatgtgcaacctcgaaattttcttcattttttgaaccaatttttcgtaattttcaatttttttcttcatcattgtgttttctttgcttatttggtcaaattccctttgaagttgtaattgtgacattttctttctctgtcgacacttggaagcggcaattctgtttcgttctagtagccttgcacgcttccaagctttagcaccgtctttcaagcctgcagtattgttctctattttttggggtctagcttcctgctttatttggaaggttgctgtagtgtgcatagaggagaagggcgcggtatgtacgtctttctcactattaatattgtttttcagtgcagaagtggcatccttgtattgtggttttgagttggcatgtgttaaattgacatcagggcatttcgattcgtatggaaggctgcttgaaatattcaactcggcattttggcaggaattattaacagtgtggtgattaacgccatgggaaattgaagaatggacggattgattttcgatattatgatcattaatgttttggcaggaagaagaagaggaaacggaagaattagaggctggagtacatggatgcacattcaattgagcgtttttccatgccttagtttgcatttgagcttgtaatcggagttgcatgttgatgtaagcctgattcattgtggaatcgccagatgggatagaaggcgtggcagaaggaatgtcacaagtggctgctactgcgggtatgttaagctttatattgctatcatacggggtcattgcagcgtagatattcttgctacctgtttgaggtgcagcttcgggtatgactgtagcttgttcgtgtggttgtggcacgttttgcaattcgttcgagctaaagcttgggtatatggctgcgcttggatttgccacctgttgaggattgggattctgttgcgccttagacgataggatcggaggctgacagttgtaaagattttcaaccgtttctaagtcttcgcctaattgactaatctgaccattggagatagatatgcgtcttttgtacacgggctgatcaaacgctggtaaagaactttgaaaaatgggagggttggtaatgggaagatggctgatgtcgacgccaaagggttgaaacattggacccaggttttcttgcacgctacggtcatgcaaactgttttggtgatgaaaattgtaggcagaatccacaagaccaggacccgatggttgtttgtatataagctccttgtttgaagatagaaaatctgtatataagagtgggttctgccttccatctaggaaagaatctggacttgtagcaaaattatgcttatagtccatactttatttggttccttagtcgttacctggtgttattccagtactattaatataactcagtacaattagctgccgtgaaaaaaaaaaaataataagaatacagtttctgcgcttttagtcggtaagcactcagattgagagatctagatttactatattttaataataaccagttaaagcagattttgaagatgaactaacataaaaaaaattgatgaattatgtaacataatcttctgtaccaccagggtaaatcgccaaagaatatctgcatctaagaacaaaagaaaatggtgccctaaatatctttcagatgaaaaactaattatatatcactactaaaaaaagccagaaaaagaaaaaaagtaaaatagaaaatagaaaatagaaaatagaaaaatagaaattaaaattaagagcattttaaaattaagtctacaaagtaatacttggcatattgcttaactcctcacgcagagccttagcgtaccactattttatctgataccacaaaaagctgcgctttgatggcccaacggggatataatcgcgccactgctactcatgtgctgcaaactaacagtgccagcagaagcgagcattgaaaaactaaactttgccttgttctgcttacttcatgcagaggtacagcttcgatgtcctaaggttgaacatcatcttgcttcgatttcggtagtaatcattttgcctgcacgccattgtatgaatctcgtgccactccctttttaactccgagatacaactttccgtggggaaaagtaccgtagtattgtaatttcgagagcatctttacggtaattgcccctccacacccagacgttacacaacccttagtaaacagctgcggaaaaaaagtgtgcctacgcactgtacgactcctgattgattccttcattagcactgactggcttacggtgcacataagttattaagagcagtttaattcagttgctgaatagtcacgttgatgagcacgaatacctgaaacaccaacggtaatgaatcaattggcctagcgcatcgttgtgtgcttgggtgtgccgcacaatggcaaccaaatactgctcgttcctgcacttcgaaagaaaagcagccaaaagaaaacgcgttttcctttgcgagcgctggtttgttcctcagtttgatagaggcgttcaattggcaatttgggcactaacaccgatgataacaagatatcttgactttgacctctgatattgaggcgttccaaccaataagaggggctgacggttgaaaataagggtaaaagagagctattcgggttgggtcgcagattaacttagaaaacatgtacatgcaaatgttgttttttacgtacagaaagaggctgatggaaccaaaggaagcaataatttgcaccttgatattttgcgctttctgcttttgaaaccttattatatgcctttacatatactgtcacgcgacattttcaccttctacagtgtttaatgaaaatctggcttgtgtgcattatcttttttgtgaaagtttatctccgcttaaacaaagcgattgaatcttgtctacgtaattgggctcgtgggaccaaaaggctactattttccaggaaattgaagactttgcaatcgtaacaaggtttctttcatcgttaaaatacaatcatacatagagatatatgggcaaaaaccatttcttgaaggatttctctgctttaccggaggacgtactcatagaaaacgagagaggcataactttacttggttacccactattttctcccaagattttactgcctcacgttgacccaccacaatttcaaagactaaacactgaaaatggctcgttaattgccctgtcgaaaaatactatatcgaacttcatagaactgtatcctatcgatctgagtactgaacgcactgcaggcagtagcagttcacagatgacaaagtggttcgtactgatggattacaaggaaaagtacgatattgacgatcaaggatggtgttatagctggaatttcaataactctaggtggaaatcgaaaaatggcttggtgagaagaagggtctgggtaagactacctacgaccagtcatggattagattagtaatagtttacgctaatattaaattgtttaacaaactaagtagtcaaaaaaaagaaaaaaaaaaaaaaaaaaaagaaaaggtgacattatgcagaacatattttatcgatccgcttatgtgcacacagtttgtccagctaggctagaatattatttattattaccattattattatattattattattattatcatcatcatgaacctgatgatccgaattgtgaagcccacttttcgtacttcactaatccgtcctgggatacagagggcttgatatacactaaactgttcttaaaatccacaaggcctatgggtcttatcatctccctctctgtttctaataacttatcacccagatctcgtagtgggcccatggcagcatccttcgctaaagacgttatatcacttcctgaatagccctcagtaatctttaccagttcatcaaaatctgattcggttaacgtgtgcttttgatgggaaagaagcttcttaaattgaacgtgtctggtctggtcctctggtaatgggatatattgtcttctcacaaatcttctccttgcagcctcatcaatagaccatggtaagtttgtcgcggcaagtaccagtacccttgtatcatcttcgtcgccattggtgtcagaattgttagtgttacttttgtttgaaccagccgctgcgctggacaaggatgaccactgaacaagaaattcattctttatccttcggcttgactcattttcattttcgttattcctactacccatgatagagtcaatttcatcaacaaatattatagaaggtgacaattttttggcaattgcaaatagtgccctcactaatttttcactttcacccaagtatttagatgtcaaactggaagcactaatagagaaaaaggtggagtgcgactctgtagctacagctctcgctagcattgttttacctgtacctggtggtccaaataagagcatccccctgactggttcacgtaaccccctgaataagtctggtctcaaaaacggatagacaactgcttccttcaaagaatattttgcactttctaaaccagcaatatcatcccaatgaacttcatctccgtgcactacgatttcggcaaaaatttgctttgcagcttgcctatctacaccttgtaaactatcaataatttcatcttctaaaatctccctcaggactttcttgtctatttcaggctcttctctttgctcatttagggaagtggcatgttcagtggcatcttctgttccaacatcttctatttttggagaaccgatttttttttgtgctggtatttttcgattcgttttactcatagacgtggtttgatttttcgatggcttcttattctgggatgcaccatgcgagtatggttttgagttacttacaggtctggaaggatggctactcgttttcttcgaactggaatttgggactttcgccgttttggatttcaaaatggggtgactcttcttcgtagtgtttaatgcggggttactcgcaacctttttgctgttcagaactctcttagcagccattgcagccgttttgggtttttgaattactgaatttggaacagtcagagaagaggtcggagacgatgcattggatttgatgattggttttgtattactttttgatcttgtaataaatgttggcgttgatttagtgataagagtgggcgttgatttggtaccctttaagtatggtacgtgattattcttcattaattttgatatttgaggattcctaatctttgatgaatccatagtagtagaagtttctaaactatgtggctttagagcgccagtgctggacgctctatcgacatttaataaaggaggtggaggtaatgaaggaagagcaggggcggtagtcggcagggactgtatgcatgatccgggaacattttctgaagaacttacactcttattactggacgtagaagaagtaacagacaagtcagacatttgctgttgaattgcttctaacgtttttatacgtcgtctttcctctttttcttcttcttcttcttctacgtcgacttcggagaaattatcatagtaatcggacacatcaaactcgaaaccatcactttcttcttcatcaaaaacgttgtgtccttttaaaatgccgacatcgtgatcatcctcgtcattagtcaaatctatcaatattggctctgagatatatttatctgagtacagttcagtttccttcttaagtggaggatcattgtgctcaatagggttcttgtgctgtctgcttgcattgttggataaaggcttagaaggtacaaaatttactctaatgttctccgcatcttctccgcgttttatcgatgtgctgttaccatatgatgatagtgaggggttggagtatgcggttttatagccgcatgcatttctatttcttaatgttttcatcattcttccgggaaccatttggaatacaggaggtggttcagtagaccttgtgaaagatgagctatgattagtgtatgttttggatgacggcatatcattcctgggagcaggctcttctcggaccaattttttgactcttttcaaatgcataacgctcttgtggtacaattctcgaataccgttctgtaaactaacttcatctttcgtgtatgattgagtatttgggtagttatgctctatcaatgtctgtttgaatagtacatcagtggtaagcgctttccatccttgcaatgcttctttatatcgttttttctcttctaggttcaagtaatatattgtctcattggcaattctactgtaaagttctgtaaagtcggttaacggttgttgaggtcttctccgtatcttggttaatctcgttaaaatatgatggcttctttgtgaatccatagtgtcacagtgcgatataatcaatcctggtaaaaccgcacgagtgaaagggaaagaaaaattgcgtttgttagctgcaataaatgtaaaaagactatattaaaaaaagaactgcagcctttattattaccaatatatttgataagaaagtatatcggacgcgtattgtagttcttggggagccggttgctgttgcttcagcctcttatgaccgtgaatcaagaatttttattattcttgatttcaattttctccgcgaatctcggctaagatgcttgggttgccagtgttaattccatatatatactgaataatagaaaataagttaaaacataagtgctgaagacttgaaaggttggtgtgagaaaacccgtatgcctgtgatatgtctagaatacatagggttttttttcttcgctttgtaattgattgcgctatatatgaaaaatatacatgaggcgttattaacttgctgagcttatctggccacagtatgttttttgtgttccttctcctgctcacctaggattagctcttcaaaaactctagcttcttcagcttcttctggtgaccttctagcactggcaaacttgtgggcaataaacagcattgcttttgcctttgcaatacgttccttggaagggacctttttatcgtttagaatcttattgcaaacgtcttttagttttctttccagttcaaatttcgacatagcccacatgacaccaagtgccttaccagccattgtggactcaaatttggcacgttcatattggtctagttcgtcagtattgacttcactcattttttccatggctttttgagcttctaagcctgtagacaataaattgtatgctgatttaacagatctagcattgtcgcgtgtaccagtgaatattttagaaattccgtaagtcttcttggacatgataaaattattcgcttttgtcttgtaaaccctggccaataaatacaataactctagaccaaaactttctaatttcaaatcctcgatttcttgatctagttttcgcgtaaattcctccaagttattggacttcacagcaattaagtacctagagattttttcgttcagtttttctgccaactcgtcgacttgtttcatcatatcttcccgtctttttttctccatttccattagcttctctctttgctccttcgataatttatcttttttcaaagattcagctttattagtgtcatgcttaaccattccaccatcagtgctctcatctgctttttcggtttcagtggctgctgtaccctcctcatcttcctttccaaacatttctgttgcctcgtttagctctttgaacaaagaaaattctccaatccaatctttgaagccatcaccaccgaatattgctgtaaagtattcagaagcatcttcaaatccttgctgaggaacagcatcctccttaccaaactggtcatacttggaacgaagccctggatcacttaagacttggtaggcctcgcctacggcttgaaactttgcttgagcatctgggtcatcaggatgcttgtccggatgtgtttccatagcctttctacgataggcctttttgatttcagtgggcgtggcctcaggcttgatgcccaaaatatcataatactccgtctcctttaccatattccctcttttcttttcctttgagttaatacgtcttaattacgtgaagccgacaattatctaagttgctctttttacaggcgtaaaccattggaaagcaatggttacggctaaccgcggatccgactatatcaccactttaacactttatcgtccctgtttgtccttggcagtgtacattcgccatcaaattttccgttctccgccccatcttggtatgacgggcgaaaacaccgcagtgacgttcccagggtctaaaacaatccataggagaaccacttcgattcactgtcttacttctcaaatacgaaattttttggattaatcatcattgtttatttctgaaacgctaaccgaaagtcttcatcatttgatttgactctagcagatattctccaggaaatgttagaatgtccggtaattccgtttgctatattctatttgttgatactgatgagcatcaaaaaattatgtaataagggtatcaattcgcattcttatatttaatacatacccagttgtttgtagctggttcatatttagcggcaattctctgttgcgtaaatgaaaatattaatgtaaacaaaaaaagaccaaaacattttagcagtgtaagaaggtgtactgatacaaaatgtgtttagagtctactgatatgttactgaccgttcgttgggaaaaaaatactgtatcatttattaatcaaaagcgacttttggtggaatattatgatatgtgttgttaaaatatgacgtaattttagaattgtctgattcgtattcaaatttggtgaaggaataacgcagagttgacaatttaatagaatggattaatcgtaattttcagaaacgtagaaaaagaaaaacaattaaaacattatattaagattattgatttgccttttaagggtccatactcctgggagagaacattcaggataatatatatacctgagaaactggcgagtaatttgataattgttcggattgcattgttgccgaatcctataacattaggtatacatagtatacaagcaattctcccgacgttataggaattcacaaaagagaatcgatggtgttactttatcttccttcccgttatactttgtctttcattatcctattagattacatttcagtttccatcaatttttgatggctgtctctcaatttatattatcttcttataccgtatatgatggtatactagtttacaatattagacgatggatgatgattggttcttatcataatttgatttcggcagaagcaatattagaggtattgttgtaacgaaattccaatgtcatctgcttagtattattaatgttacctgaatattatcacatgctgcttaaaaatgtgttataagtattaaaatctagtgaaagttgaaatgtaatctaataggataatgaaacatatgaaacggaatgaggaataatcgttgtatcactatgtagagatatcgatttcattttgaggattcctatattcttggggagaacttctactatattctgtatacatgatataatagcctctcccaacaatggaatgccaacaattatcgaattattcaccagtttctcaggtataccttgtatacctaatatcttgtatacctgatatcataatgttcaataacagtaaagtgctaataattatgtatttttttgccgatttttcaatatttcacctgtttatcggtgtcaaagtactacgtttagtttactgtagggttagttgatttttttacggctaaatttatgttgtattacgggctcgagtaataccggagtgtcttgacaatcctaatataaacagtcttagggaagtaaccagttgtcaaaacagtttatcagattaattcacggaatgttacttatcttatatattatataaaatatgaatcatattaagtggtggaagcgcggaatctcggatctaaactaattgttcaggcatttatacgtttgggtagttcagctagggaaggccgggttttatctcatgttgttcgttttgttataaggttgtttcatctgtgttttatgaacgtttaggatgacgtattgtcatactgacgtatctcattttgagatacaacaatttacagttgtactggtcctatagtgtagtggttatcactttcggttttgatccggacaaccccggttcgaatccgggtaggaccttttttattcatttttacataatatatgctgaatatattggttaaagaggtttttttagttcccaaatgtccacagtaaagtagataaagcaatagctatttccatcaaatccaaacaatattgtattacccacttattattaaacaatgcatttattggagaaacacccgctttccgggtaatagcagtctatttattctcattcatttataagcggcggagaaaaatgattgaggaattgatataattacacagtaactttacggagcctaaggtaacaagtgaagtttggatagcagttttattcccatttttatctgcagtatagggaacttggaatcaccttttgaaagaagagaaatgcctggatttacagctccaacaagaaggcaggtgttgtctttatacaaggaattcatcaagaatgctaatcaattcaataattacaacttcagggaatactttttaagtaaaacaaggactactttcagaaagaacatgaatcagcaagacccaaaagtgttaatgaacctatttaaggaagctaagaacgacttaggtgtcttgaaaagacagtctgttatttctcagatgtacacatttgacaggctggtcgtagaaccattgcaaggaagaaaacactaaaacctggcctaactggtcattgcatgtaagaaagaactttccagtaattttttccttctcacgtcaggaaattcgtatggttatatcttatagagaggtggccgcctttaatttggaaaagatattattagatgatattcctaattttcgaccgatactttgcatggttggacttcaattagatcatgtaatttacttccttaatatcaatagcatttcttttttggtagaagatttttcttttcttttcttttcttcaacccacatgggactataagaggagagtttatagcttgtatataaaacgctataactaaaacataagcccactctgaggtgagatgtctttacggtatgataacaagctgatgcaatgagagatcctatgaattgcttggattcttttacatcaggcataaagtttccgaagtatgcaataaaatgagtatttgcttatttattgtttgtatcgggcgatcttacacctactttatgtgcgtaatagttgcatcttcttttttcggaccattccatcggataaacttcttaggtaaaagtgaaaaaaaaaaaaaattcgcttatatattaatcaagtcatcacttggaagccgttctcttccgtttacaacacgaagagccaactgttttcttgtgtcattctttagcactctttctttttatttttacattttttaattaagatcaccaaatataccgggaatataatgaagagaaaaactgctgaagttaaaggtgagaaggagagaaattccaaacaaatttccctcgaagaggacaagataaagggtatgttcaaccctaaaatctgggacaagactttccaggatggcttgaaaaaggaaattgaagactctcagccttacaactggggtactattcatgaattggttaatgacgatcttctacgtgctgttcgtaaagaaatagaaactgagatccatttcactaaaaaagaaaccgatatctatagagtcaaccaaagtggtgacttggccaatttgtctggtctggactgggatgacttgtcccgtttgcctaatttgttcaagctgcgccagattctgtattccaagcaatatcgagatttttttggctacgtcaccaaagctggtaaattgtctggttctaagaccgacatgagcatcaacacttacacaaagggatgtcacttgttgactcatgatgacgttattggctctagaaggattagtttcattttatacctaccagatcccgacagaaaatggaaatcgcattatggtggtggtctaagactttttccaagtattttaccaaacgttccacattccgatccatctgctaaactagttccacagttcaatcaaattgcttttttcaaagttttaccgggtttctctttccacgatgtcgaagaagtcaaagttgataagcacagattatctattcaaggatggtaccatattccacaagttggcgaagaaggttacatacctggtgaagaagaagcgtgggtccgtaacaacacatccactttggcgcagattgaatctaatgtcctagaagattttgaatttccaaaggacgagagaaatattttatcatttcatgaagtgaagcactttgaaaaaatgctcaagggcgatgctggcgcaaaaactgataacacacctaaagaatctatgactagtgtgatttctgattcggttaagttgtctgaagccgagttcacctatctatctcaatacatctctcctgaacatttaagctcgaaaggtatcgaaaaactacaaaagcagtttgttgagaactcttctctacaaattgagtcgtttttaaatgacgataaatcagaattgttaaagaaggttatcaaacaaaaagagttggaacaggaatgtccttatcattcaaaagatgtgaaagctccgtggaaaacggctattcctccacacaaagcccgttatttgtacatcgacggtaaggaataccgtaatttccaaacagaagctgatattcttgaggcgctgaataacaatgatttgccaaactttcagtttactaaggacgcaattaaaattatctccgatgcttccggaaatagtagggaaaacaattttgatgcagaattagcgttgattgacctagctgtatttcacaagagcacaattttcaagaaatacctagctcttctaacttctttgtgcccagtcagtgagcaaatccttattagaaggtttaggccaggaatggatttcacattggccaccaaatgtcgctttaatgaacttttgaaaagcaatccagatataatcgatgctgtcttggaaggtactttgtgcttgacaccttctgccggttgggaatccggagagcttggtggttacgaattgtacatgatggacgacgacgaagataataagcaatacttaaaggaagacgttgaagacgcttctgtttatcgtgcggatgacagtggtgattcagtattgattaatgatccacctgcttggaatactttcaatttggtcttgagagatgaaagtgttttggagtttgttaagtacgtcagctggagcgctaaatctagtagatgggatgtcaaaatgaagtgggatgtcaaatcatgtgatgaagatggtcaggaagatgaagcgtaaacaattaacccgtcttattaagtaaatggcagcttagatatttataaagttgtataatagaagtaataaaattatttgaaaagttattcgtcaatttcagcttattcctctggcgtgaatatcattaccataatccaaattcgagtaagcgaataaaacgggtatattaaagaaatataagaatgaatataagtttaacttaagatctaattgcgattctttttacatattgtatatttacagacagaactatgaaatgccttattttcttaattatttcatgtggagaagcattagtgtagtacagttcacattaatcctattgcctggcaccgtctaatggctttcgatagtcttctttgattctttgccgataagcctgtgatatccctatgttggattcttcccgtggaggtcacatatcttgaaagtattcttggtcttgcataaaattctagtggatttgcaccggacttcattatatcgttcctgtttgagttcttgtttgcctgatattttctatctaaatggattcgtcccatagagaagtcaaatggatcgtagatagtacctttgggaagttttttggacaaagactgatcgattttctttgtttgttgcgttctccccatttcaatattgacactcttcttttctttgataccgaaattgtatagagcacgtttaaatgtggagcttactgctcccttgatgataggttgcataccgttttgaatttttatgcctgtggtggcattcatcttgaacatccgaagttttgtgtagaaccttgcctttttggttagaactgtaacactgttaataatggactcatatttaagtatgtaaagtaatcctagatattttttcccccaacaggttaccctacaatgcaatttaaaggcataatagaacatctaatagaagtgggtgattataatgagtaagaagacgtaatgatcataaaacaaaatactaataagctatggtgcaatgcaagatcccaatatttgccagcattgccagttgaaggataatccaggcgcattaatttgggtgaagtgtgatagttgcccgcagtgggtccacgtgaaatgcgtgcctttgaaacgcattcactattcaaatcttacaagttctgaagttctgtcttatccaaattctgcgaagcaaatcaagagctaccgttgtcctaatcataaggaaggagaatatcttaccgcatacgctctcatcacacaaaaaggaaagcggcaaaggaataaagaaaaccctgaagatagtcatataaataagcggtataatttcagaaagaagaaattacttgactatatcgctttgaatgagggtgaatcgaaaagggataaaatgaatcaccctcataaggagagtttcatgaaatcttttgaaaaatggaaaaatggctcaaatattataaacgccgctgactttgctgaaaagtttgataatatagatgtgccgtacaagatcatcgatccactgaatagcggagtatatgtaccgaatgtgggcacagacaatggatgcctcacagttaattatatcaccgaaatgataggcgaggattatcatgttgatgtaatggacgttcaatcacaaatgaatgaaaattggaacttgggatcttggaatgaatattttacaaatactgaaccagacaggagggatcgaataaggaatgttatatcattagaagtctctaatattgagggattagaactagagaggcccactgcagttaggcagaatgatcttgttgataaaatttggagtttcaatggacatttagaaaaagtcaatggggagaaggcggaggagaatgaccccaagccaaaagtgaccaaatatattttgatgtctgtaaaggatgcttatacggattttcatttggattttgccggtacctctgtttattataacgttatctcaggacagaagaagtttttattatttccacctacccaatcaaacatagataagtatattgagtggtctttaaaagaagaccaaaatagtgttttcctcggtgatattcttgaggatggtattgcgatggaattagatgctggtgatttgtttatgattccagctggatatattcatgcagtttatacaccagtagactctttggtatttggaggcaactttttaaccatccgtgatttggagacacaccttaaaattgtggaaattgaaaagttaacaaaggttcctagaagatttaccttcccgaagtttgatcaagtgatgggtaaattatgcgagtatcttgcgcttgataaaaataaaatcactagtgatgtcagtgatggggatttgctttccaggaccactaattgcgcaattcaatcacttcatgcatacgttataaaacctgaagttaagtacaagccgttaaatttcacttcaaagaagcatttagcgaaagctttagccgatcttatttcgtaaaatttcttcttgtccgccacgttcttgtatcttttatttcatcctatgctctcgatgaatgagatctactttagcaattgatacagtataaccctgacattacatttagggaataatcgccccaatataggttacaaaacattaatatatatgtaaatatatgtgcgcgtatatatatatatatatatatataaagggaaaattaatattctatcattaaagtgaagaagaaaggtggatttaaattccaagtcttttcaattgttctaaacgttcatcaatggcatgttcaaattggtttgaagtatttgtccgctcacttagtaacttggcatgaatacattgtagcgcttttatggagtcagattcattgataacgcaggatatgtttatttcatttgccccttgagaaatcatttcaatgttgatgccttcttcagcaagagtagtaaacatggtaccagcaatgccgatgtattgtttcatatgtttaccaactaatgaaacaatagacaacttctttgtgatatcaacagaacctaaaattctcaatttttcctcagcttgtctcagagattttaatgagtctgcatctggaatgggcaaagccatcgaaacatgaacttcagaagtagatattaaatctacgactaacttgtacttatccaggatggtaaatatttgagctaggaaaccatgggatagggttttcttattggaatgaatgttgatgacgaaaatgtcatttttggtggtgatagcagtggcacctctctttctcttttcatagaaagatgaggataagttctcaggaggatgtggtggagtagattcacccttctttgctacattatctgggtagataatggtaccgttacctaatggattttgaacattcttgattctaataggaatcttagccctaataacttgttccatcgtaaaaggatgtataacttcggaaccataatatgttaattcagaagcttcttctggagtaacactgtctagcaaacgtgcttcaggaaccttacgaggatcagcagtaaatataccatcaacttccttccaaacttgtagttcatcagcatttacagcaactgctatcaaagcggcacataaatcggtatagccacgaccaacaccattcagaagaccagttggaactaaaccaaaaaaccctgtaaagactggaacgatacgctctttagcacttacaaagggggccaatttttctttcaatgcttgaaccaggaaagtgtagaaactgttatccaaagcgctggcactgaaatcagagggaacaatgtggctcaaatccacatatttggccttacagccacggtcattacataaagcagtcatgaacaaacaactcaacttctcaccacatgacatcaccagatctactgtacgtgaactcacttcacccaaaacttttgaagcatttaaatatttcttgaccagttcaagttctttattggtatcatccactaacttggcttgcaaggcaggattgagaatgaagcggtcggcattatcgatatggtcttgtctgataacttcgataatgtcttgaaattcagattcttgcgaagccaaatcacaacatttcaaaagacgagaagtggtaccttcagccttggtgtatgaagaacgggcggaacaaacgacagcgacattattgtttgggccgtcaggtttagaatagtgcttcacaatgtcatccactatttggacgggaaatttaccgacagatgtaccaccgaacttttgcacgacccagttcgaatgacttgatgtaggttggaaatccattggcatgtaaaagttaaaaaaaatgaaagcttctgtgataaaatgcgatagctatgtgagcttaagcgatggagagagtattggctacacaaatatccttcaatgagtagagcactgttaaaatagaaataaaataattatccagcagtattcttatatatggatattatacattatttcttcgaagctaaaagaatctctggagaagactgcgtacggaaagtgaaaaaaaaaaaaagtgatgatgaaattttcgtttgctagtgaaaaagaaagaaaaggtgagtcatgggcctgaaaaatacacgtggttagagccacagtagagtaaaaagttgatattaggggagttctagaaagaaaaggatcctgtgagaccaatgacagtgattgtaaattgtgggagtgatatttgatgttactatcaaataaggcctcagcctctgaatatgttcacctaaaaattgtagaagattcaatcgcgagcggctggcaagtttgggcatgcatcgagtattgccgtatatcgaaactaccttataaatgtgtttctgatatggcactttcaaagttttcctgggcctgttcttggcttgagaaatttggcaatcataacaaaactcttagtatgaaaagaaattgtaggacgaatatttattaagacatatgcaaagaagaacaaactataaatgccggtcatttactaactttatgaaatcctgtgtatacaatattcctctagcacagagtgtttacgataaaccttgccgattgaatcgatcagctaaccggtggttggtaagcctacataagccttgaacgaatcgtaaattagccattggaaacttgtcaaagtaccgatcatgacaattctcaccattaacccattccacaacccagtaaagccaattttttgatatattcttttagaggctacagacatggactcgttggcctttctttcgctattgatcttggaaaccataacgtctgcaggatgtgagactgcagcacataatatacctgccagataaccacctacaaaactgactgatatttgctgtaatgcgttcatttcttctttctttttaggtaaaacactgtatattttttgaacaattttttcgaatgaggtaaacttacacattgtgtaaggaatctgtctgcaccataggggaacaatacctttataaaatgctttcatacctccactttctgcatacatttttttccatccatcaacaacgttattgcaaaagggcggcatagtagtctgctgtttcactttaatagcttcaaatgggcacaacatgatatcagcgaggaattcagcggtcgctgaggccatcaagtacacagtgacaccaggacttaaccaactagaatacaaatgcttgaaatactcataaccaccatacttacctgcaccttgtagcgaatatccgacgaatgtagcaccaaacccagtgtatactttcttccagccttcattagctataatcttacggaacccttgtaagtttgaagtatacaacttgggattgacctgtagcctacatttgacaagatctagtggagtgatcgaagaatgtgttggaccgcacgcaattataccacctaaggtacatgtggcataaaactctttcgtatataattggattttacgtggttgtttattggactccatgctttacaactgtcaatgagtccgttctctttttcccttactttatttttttagaattaaaacaataacagaacactttcagttaacaatgtgtcattgactgcctggaaaaaaaaataaaatatctataaaacacaagcaaaatgaaagtatatttggtaggtcccgctgtatttatatcaaatgtaacagggtatgcagaaaatcgatatatccattttcctttttattaagcaaaatgaaactaaaaacaaggaataaacctaaaaaagatctccttatttcgctaatacccctgaagtccaacttttggttagccgagatcttagccgaatgagattgtgaaatgcaacccaaagtgaccgttgttgctagctagcatatgaatgaatctaagaactggaaaggcaagttaagggccaaaaataatgacttgaatattttgcagtatctacgttgaattaaagtattcttcgtaagcggtacttttcacttgctacttgtcaccttattacctatgtgctgagagggtaatggtacgatgttcctttttgacacaatgcgtcttttccctatgctgtaacaaaaaaaacaaaggccgaggttcggatttcttagcagatcacgtgctgactttttggaatacaccgttaaaattctcacacggttagtatttacattttttcaagaatagggttttgccgcttaccttgatatgcgggcgattttgcgggatttctgacatctaataacttagtagtcattgaaggaacaaagttttagtcttattcggatgtttcccttcttattttcgaaatgaagctttttggagagatggggataggtggctttttgtgccttcctcgaatgtctagccgagtcttgcgatggaagggctagacagcatgttttagagatgtagtaagttatattataatcatattataattgcctaaatatagacgtatatcatatacaatagcaaaaatacataattacgaacataaaaatgaaaataactttggtcaaacagcgtgagctgtcaaacgtataaatcttaaaaaacgtgtattaagtatgagctaagaaggcgctcatcaatagaaaaccggattaaaaacatcgaaaattattgaaaaaatattaagtgtagtgtggaaatgaatgagtagaaaaaagataaattagaaaacagaacatcaacttcgtaaatagtaaaacgctaagccagactaggtagaactgactttgcatacctctcttggcggcagtaagcagattagctgatttaaatcactgcaagtaaggaacatcgctcttgtttctgttcatgactgttctatgagcaccaaagtagaaaacgaaaatgaaagcgaaaatactcaaaaaaatctctaaatcttgcattgtagtgtgtactgtgtagtaaagctattgtttgtttttattatttctatgtagaattctgtaaaaggacgaaaagaatgtttccaagcagtatgtctacctctgtcgttgtagaagggattcctacttctttatatacaaaatgcacatcggtagaaatatctaattctctatttaattgaatgcataaggggtaccaaaaaatctctcttcacgtcttatagctgaacagttatcggatataggctaccacataaaagaacagggatgtcctaatacagcaatcattttttttttcattacgtaaaaagtaaagtaaaccatccattctcccttctttcagtcaaatgccgcagtcccttacatttcaaactgaagcgtcgggatgagactgtagaaagaagtaggagtagtatgcaaaaaaaaaaaaaaaaaaaaaatataacctctgccggaagtgaaggcacaaaaatagctctctctaaatgggcggtggaagggtgttcaaaagtaaagaaatataggcgcacttctgaagtcatcgtaggtgaataagcaagtctttatcggcatgttcggggttttttttaccaatgacgatttctgtcacttaactttttaggccttccgtggtcgtgtcatagcaacccctagttttctcttcacattttgtcgcgtttccgtcgcacagtaagagctgtatagcgttgaatgaatgtaaaaaatgctcactgaaggacggtagcctttaccagtcttttacgtgccgaatgcacatttgtatatacgcccacacacatcgaagatcggctcccgatttcttgtgagatatttatctgtttatttgcttatttgtgatttatgtatatttacttgaaatattctagcatgttttagagttatttatcggagttcggtcccaatcatgagagtaactcaggccaagatctagcaagtcattttgctttttatgtccattcttcatctccttccttctggttgccttcatgctgccgccgcgaagggatcgttaaagccatccattacaacatccaccttataattattcccgttgttgttgtcccagtactcttcgcgctcatagtcgttacgtgtagaataatgaatgcaaaattctaacttgccgcgaggatccactttgctgacatcatcgataatgaagtggaaaatgtccatgttagtgcccggcaatattccatcgccatcactgatgtaaacgcattccacttcatgtgttgttctccaactatcccacgtatatcgtaccaccactcttttatcatagaaaatgtttttcactagtatccttccagcaattaatcttgtacagccagcgttataacccttggccacaccattacagtcattaccattgtggctattgggaatattataaaatgaggaggaatttgaaaagtaattgttgtctctatggatgtataatgacaattcttgtagaaaaactttcttattttgtgataaattgataaaaatgttcagctttaaacttttaggattcttgttgcttaaaatggggaagttcttgctgtataatccaacaacatggtaattttttgaattacgatctgaaatttcatgagcaccgccaccattaacgaattttttatttgattttgatggtggcatgtcggtcctgttctttaggaggttctgaaatcttttactttttcttaattttgtattgttggtgcctttaccattgtttggattcgaaattttagcaggatgtgcgaagccttttggcgcaactgtcgtcaagtcatcatctatggatgtcgtttctaatccagatgatagcatttttgtctcttcttccgggtccaccattaaattcactggcttatgcttaaagcttagacaattatcgtgttgttcagttttattaacgtttatagggctttcatcctcagcaaaatattttacaggtgccgcctgatcaaagtgaacactcttactcctaatcaacatcggactaccgtctcttgcttggacaccattcccgctccttatacctggggttgtaggtaatgattttgatcttctcttcaatgagctcttcaatagttcacctgactttttatatacaggtggcgcaaatggaattagaatttcttcatcatattcaaaattcatatcattgccaggtgacttagcttcgggatattctgcttgaaaagattttggtacggtggatttgggggaaaggggaggcagctctattttgaatgggggtctcgtactgccatttaatgattctacggaagtgtgattcttggcagcggcaatttttgaccagccgctctcattatcaacgttttcatcattccctgcggagaaaattcttttgtttaaatcagtgtttctttgcacttcttcctctgggaacctgttcgctctcatttgagttactctctgaggtttatgtaaaaacttcaaagagtttaaagtctcttccgtacttccatctcgttctttgttgtataggtccgaattcactctgtaacccttgaaatctgtttcaagatctggtagctgctggtttttatttctgtctagtttttcattcttcctctcaaactgttggggtttctgttctgcctttatatacattgttgcgttgatgaaatcctaataaacttgggctgtaagaataaaattttgacaagatatctgtacccgttcctattaaacttgtttctgagtacaacggagatctttttgatgttcagcctactaaaaactataccttacagaaagaaaaaaaaaagtccaatgtggttcctttctcctcaatcaaacagaatgccaaccttccttgtttcttttccttttttactactaaaaggttttataaaccagacttctctctttaaacgtcccgtcaaccctgcctttagtaactgctttcccgtctagctttcttttcgttcctattgttttaaccgtattgtatgcaggtttaccttctataaatatgcactgaactggaaaggctatgtttgaaaagctttagttttcttctgttgaacggatgggccctgtgttgcttattacgcaatgcagtatatataaaggaactcaacctgaagaagaatatgcaagatatagaaagaccgttgcaatatcgaaatatttcctgttggatagaacgaacttcttggccccttcattgagaagcgtagctgatacacatttttggtaaaagacctcatggtagcagcccctttccccttaaaaagacttaatatggcatactgtttttcttttatgcgcttcattccacggcaaaaagaacctttccccgcccccactctgcgacaggagtttgccgcccatctccacaataggcatagttgtcggtaccttccagcgctacgtcagcctcttccgggcaaaaaatcgacgtagcatggaaaaatgcattctagacagctttatgcgttacgatccccaatctatgctccctggggagagtttgtacaggttttctccaaaataaaaatacctacaaaactccgaatatttatgggtagctccagttttcgaaaattggagaaatgaagggggttgaagaagaaggtttcatgagcatgaagacggtagtaaagctgacaaatatgctacgaagatttaacttcctggggaagtagcaaaaaaaaagaaaaaatattcacagagataacctcaaaacacacttgggaagtcatgaggggtaacttagaataagatagaactctatcaaattattgcctataaaaaatacaaaattaatcgggatttggcttccctttttctgttctatcttatacacgacaattagaaatttcgaaaaccatgatatcagatgcgccgagtcttttcaattcatctaaaacaacacccttcgtttttctctcaatcatggaactaacagcaacccatccttcatcgtcaattttggaaatggttggtgctctacggccaggcgtcaccttcaacagttcaggcagcttgtcttcaggtgcgttataaatacatgaaacgaacctttgagcggtcatgacaccttcaattcttgatttgatagtagcaatcaaactcttatcgctctttgggttctttgattctattaggtaggcacttgtgcttaggacggtggcaatatcaactaaacctgctgccctcattgtctcaccactctctacaagatctacaatagcatcaccaattcccagagcacatgatgcctccacggaaccactgacaaactttatccttgtggtcattttttcaacagtagtaccttccaaatcggcaaagtatttttcagcaagtttcacgaaactggtaacaatggttttgccaattaactgttctggctttttatactcgccatttacggggacttgtacctgcaatttacagttaccaaattgcaaatcgattgctaagtctacgtcgacgttagattcacgaacttggtcaacaccagttataccaagatcacatttaccttcaccaacaaaagttggaatatctgcagcgggcagaaagaccaacgctacaggtaagcttgtgcttagtgcaatgtctaatctttgagagcggtgaaaggtaatatcagcaccattcaaaatagaaacacttttagaatataaacgacctttctttgggattgcaaacagtagtctatcggttagatggttcaccaaatccatttttctattgaattttttagaaacctatcctttcttttctattttcaaagattcaaaccgttaataggagtaaaatgccaaagtttagacggtaaatacttgcagttcactgcgtataaatggactttcaggcgagtatattctgcaaaaatattttataagttccaacggtagaggtgactcacttggaagctttttttttcaatcgttggctacgtgcgtacacgtgttttgcggtctcgcttcgaaatgccgaaatgaaagaatttccgggaagagtcacgctgttatcaatgactttgcaactaataaattaactaataaatattttaattaattttttgacaaggagtctaatacctcgcatgctaaacaacctctctagccgggttgccgggttacatctcgttctctttacgttcacatagtcacataaccactagtcacctgtgcattcttactttttttttttctttttggcttttattgtaagactgatatgcaggccacaaagtctcaattaggtcgcagccgtgcaaattgtcttggcatttttgaagttttgtatataccatagagattatctttgatatgttactaatattgtaaaatacagtttgtagctatttttattaaatgagatgtctaaatagtttacatgaaattgcatctatgatacatgacgtgaaatgtgcacggggaaatgatcgccctaatcattacttcctaacgaccgaagtattttaattctaaaggtcttaagatgttgtagatgatgaaggcccaacttgcacccaactcgaacccaatgtcaccaccatatttaccaattaagcggccaatttcaccaacccaataggtttgacacatacccaatgcaacaccgaaggcaccaacaattaaggcagcagtacctgcgataccgataggtagatgctcccaattatcccaatcatcaatattgtaagcactgaaggaacgtctgtagaagaaatgttctgaacatgagatggcaatgtaaatagctaagtagtaaccgatagaatccatgaaattctccataaagccatcaaagtaataggtagcagggatggaaatacctaaagtggcagcattacctgccattgtccagactactcttggtattttagccaaaggtgcccacaaagcttgagcggataaagcaacagtatacatatttggaatattatttgcaatagtggacagagctaacaaaacgcagcagaattgaccaaatccgttcagagagttaggaaccaggatagcatatatgacaccacccatagcatttttgtcataatatgccttccaggttgggtcattaagagcagccatagcagaagcagcaccaagaatcatggtgaaaaatagagggaacgctagaccagcaactagggagaaaaaaatcttgtacttgtttgtactctttggcatataaacagtgtagtcagctgcataggtcgtccatcctgcggcaaaaccgaaaatagatgaaccaaaagaaagaacactacctgcagtagttgcacctcctacccattcaccacctttaaactttcctgatctcgatagttgggcaataataaccaaaaagacggcaaaattgggtacccatgaccatttctcgtatgcatgaatgacactgtaaccaaaaaaagtcacaagcacggtaccaccaataatgatcagacaaccggcccaaataggacagacgtggccggagccttcattcaccatattcagcagttgtgcggatactgaggtattcacaataccccaaccgacacaagcaataacgttaataagagagaaaattcttgccgttacattaccaaccagatatcttgataaaatcatctgtcttaagcccagttctgcaccaaagacagaaaagaacgcaacaaatatcaaccccattatattgaaaaatatgataactaaaacactttgaccaaaatttagaccgaacaccatgggtcctaaggcacccaaagcatatgatgcaatgaccatattagctgaaaaccacatggacgcagcattcagtatggaatcgtccgttttttcatcctctgtaactggttcaacaccctttgtttctgcattcaaactggcaaagaacttatggaaccacgataattttgtggcctctgatgattcaacgatatactgttggtcatcttcggaagttgctgtgaaagtttcagaagcggctaccttcttttcgttttccaagcttgagcctattacaggagatctcttctccaagtcttggatttcgtaaacattatttccctcttccaacattcttataaatcgttataatagaggataggatgttttatatgcgaaatttatatggatattgttgtgaatactattacagttaagcttacttatctacatttcaaagaaaaatgcctccaacgcgttttagactcaccactattttactgtctaaatatttttaatggatatttatattaaaaccattatcttggttggttccctaacatcttgatcatcgagaaaaaaaaaaaaaaaaggacatgaaaaattctgacaatgaaaaaaaagaaattaaagactcataattatttattgataaggcgaagacgtagcaactatatgtacgtagaagtcaatggcaatcgcgataaagctgtgcattaatgaccgaacgcgggcggcagacatttctgaaaaagagtcaatttgtacgaatacgccccccactcgggaaaggcgataaaatcgactgatatttagttccttgaggccgttccattggtgacaaaagaaaacatgccgctcgattttctaacactaagcaaatccgcagaggagtattgcagtcactttgaccgaataagaccagtatccatcgattttctgtcttggatgacctctttgctgttctccacaggtaaatcacttaaaaaagatatgagatacgttagattaattaatttcagaaattaatatgattacggaaacttggttgaaagtggctgaatttacgacgtaatctgtcttgacatcttttttttttcagcgagcattctctaggattttttgtttactttccacttggattttatctgtaggctttatcaagttcctgtatgtatggttgtgcaaggcactcttcttcataaaggaaaagatgtgttgagatttgtaaggcttttcatcagtgttagatctgaggtggtgttcacattaaattaatcgacgcaggatttggcgaaagcttctggcataatgtttggtgtttgtggtgtgtgatttctttttttgattttttcttttgcagttgtattcccatacattaaattgttcgtggcacatgaaaaaaaaaaaataaaatatgaacaggtcttttttatagcagagttacgtcgtctacagttggacaggcgattgactactaaattcccatggctatggatgacgatgattaatgaagaaatagtagctcgacaacattacaaaaagcattattcatagagcgctagagccatgaaagttttcttgtgatatgaattatttttattcgtgctttatataaaacagttaattaggtacataagaaaagtaacattttcttaaagtttatttcttagccttcttttcagatttcttggcagcttcggtttgttccttgacaaccttcttgacaattttttgttcttcgatcaagaaagctctaataattctttccttaacacagttggcacatctggaaccaccgtaagctctggaaacagtcttgtgggtcttggaaacagtggcgtattgtcttggtctcaaagtagagataccttgcaaagcgctaccacagtcaccacactttggtctggtagctaacttcttgacatgttgggcacgcaaaataccacctggggtcttaacaaccttgattttgttagaacgggtgttgtctatttgaaaatgttttcagaaagttggtatactttctcatttgaaaaatatgttagtacgaaatgtttcaataggaaggagttcgagaaaactttaaaagaaattttcgtaacacagattgagattattagctctagtcagtatcagggttaaaagtggctgctcttattaactatcgtttttcttctcattgctactaatattgtattatttctggacacaatatttcgcgcagaataagttattgatagtggattacaaaaacggggtaaattgcttttgataactatactaggacccctgacatggtatcctctcctctcttgctcttttttagttgaataatcatcatctcgtcagaatttctcgtaatttataagtgtgcctttaacatacatggatttcttcttctgaaagtaacacgttgggccatctttggttgttctgttatgcagtctacacgttaataccgtttaacactaagcgtaattaatctataatatttcaattccttctagataatatcctctgcgcctaggctcacgaaattacacggaggaagcgtcgaccaggcgactcgttggtaggggaccaagcgcgagtaactaccagaatcgccttggctcagtagaaaatgacggcctaaagggaacctagcgggggagcgtagtcgtaagcgggaacagcgaaagtcaagcttcttttttttttcacaatatatggaaaaaaatttatcacccatacataccactaaatgtgttatatatttgagaacacctttacatcctaatgtttaatggaaaaaacagtcctcgaagagcatcgtatttgtagaaggaaccaagtaaattagtatacaatgtacaatgtacattcttcagatgggaaggtgatgaaagtcatacttctatgggctttatattataaagctaaaaaatacgtagtaaaatcctaagttctaaaagacgctattaagacttgcccttaatctctttcggcagcaatggcttccatttccatgtcaacgcctaatggcaatgctgcaacagcaacgcatgatctggcaggtttgtgagtattgaagtacttggcgtaaacggagttaaactcagcaaagtgattgatatctgccaagaaaatgttaacttttacgaccctgtccaatgaggaattgcttgcttctagaacattcttaatgttttgaatcacctgttcagccttatcagcaatggaaccttcaactaacttgttgtctggggtcactggaatttggccagaaaggaaaatcaaattgttcactttcatggcatgggagtatgaagccgcagcagctggagcggattcacaaataacgggagttagcgtggtgaccataattctaatgtaatgatgatgttcgaagggtaaattttctttcgctttttcgtggaaaccaaatatcaaagttgttccttatcatgtatccgtttgataatgaagtaaattagtatttcttttgtaggtcagcagctcgcgctatggagaaaggagttataatgaaaccacgtgagcacgatgaaatagcaatatgttactattgattaccggattagaatggttaaaatggtgaaataagaagaatgattattgtgtgctcagtatcggttgaaaccactagttttggcgcttgactccactcgtgagtcatgtttggactatatatgtgccttgaatatatataaatatatatattgctatatgatcccgctgtttccaagagtagtaattactagacggctgttggcatatgtcaatgagagattagtgtactcttcgtaccatcaatccgcccataatcttctaagtgatcttccgatcgtatccatcgaactttactaaaggctcttttcggggttacccctaaattttcagtatttgatttgtattaatgtttagcattcaggtagtcgtagtaaacggacacatttgacattcaacgacggtacacacggtaggagacgtcaatttcggctgagatgagtagggctagcaagataacgtttgcagcttcctgtctgataacggcagcgacggtagtgggcgtgcattatgtgcaagaaatggaaagggaaactttgcatcagggtccgataaaagatgctaaacgagtcgaagaaaagaggttgagaaagacaaacggagttgcatcattagatcccacaaaagaaaggaaaaggtacttcaatatgagtgaacacgaggaacaaaaagagttgcgaaagaagtatgagaccatgcaaccgcttagtggagaagttgtgaccaaagatggagaggtggttaaagaatctaagaaataaacacctgtcggcagtagtttacctctctattatagactactcttgtttgtatatatgtaagaatcgtgtaattattttcaagaagccttcaaattgaaggaataatctaaaactcgaataatatcaatgttaatcaataactataatcaagaccttaatgtgcctgcttgcccctttggggattttacctctattttgaaattccattcaatcaatctctcgacgatctctaaggtaagatctcgccttgatgtggctctttttcttccgcccttgcggaaaaaatctgaatgaacgtaatttacctaagagataacaaggctaaccttgatagaaccttaaaaaacagtattggtaattgcaatagcaccaaccgtaagtgagctaaactagtgaaagattttctaaatcataacgcgcggaattccagttaatatattacgtagtcatccctcatcatagaactgttttttttttttgcaaagtattgaaccagttattagttaagttaattgtagcaaatagcgccggtatgtctatcaaaggtgattccccctcatcaacaaatgccagtagtagtccgaagtctacatattcaatacaatcggatgataaagcaaaccttggcagtggtaacgtcgatatacgtacagataattcacaacaggacagtaataatagacgcgatattgtggtagtgacgagggtagcttctgaagagactttagaatcacaatcatctacttcatcaatgggaattagaccagaatcatcttttaactatgaggatgcttctaaccaagctagggtcgaaatgaataacagggtacatggctcaaatatgaacacaattaacaaatattatccagtacgattcccaaagaataacgaaaggcaattgagcgacacaaataatttaaatgagaaagtgcaaggcacacatacagttcaatcatccacccaggaagacaaaatactcgacggtgacacaagcaactcacaagtaaccccgtctttgaacattgcagagtttcccacagacaagcttcttaaaatgctgacagcgttactaactaaaattattaagtcaaatgataggacggcagcgacaaatcctagtttgacacaagagattgagaatggtaggtgtcttgctttaagtgacaatgaaaagaaatacttaagccccgttctggggtttagagggaagcacgtaccacaaattggtcttgaccaatatttccagaggatccagaaatattgccccacaacgaatgatgtatttttatcgctcctcgtgtactttgatagaatatccaagagatgcaatagtgtcactacgacccctaaaactaatactgcaaaacatgaatctccctcaaatgaaagctctctagataaagctaacaggggcgctgacaaaatgtccgcatgtaacagtaacgaaaataatgaaaatgacgattcagatgatgaaaatacaggagttcaaagggattcaagggctcatcctcaaatgttcgtaatggattcacataatattcacagattaatcatagcaggtattactgtcagtacgaagtttctgagcgatttcttctatagcaattcaagatactcaagggtaggtgggatatctttacaagaactcaaccatttggaactgcagtttctagttttgtgtgattttgaacttttgatatcagtcaatgaattgcagagatacgcggacttactatacaggttttggaacaacgcaaaagctcaatcgcaagcactagttacgggcatgtagaaatgcgtaatatgcaagtagatatatttacatacacagtttctctcaaaggtagtaattatcttatgtgttaacgtacggttgctaagaaataagcatggtaactttcttaggtaattctttggtattaagatatattctgaattacggtttggactactttattgttcagagataagaaacatgttgagcagcactttatggtgttgctatattcccgttcaaatacaacagcaacaaaaaatgcttatccctcatcaaattgaacagaaaaaaaaaaaccatattattttattcaagcttatcgcatgatagactgtatatggagcagtcaaaattgactgctaactgagttttcattttggaaatcttatcattttgcgttcaccgattctaacttattttcatcacgaatacgagaagggcaaaggtgccggcgtcattatgtgacggaaagaaaaattcgataaggccttttttttttcactcatcgtattgccaagcaattttagtcagaagtaacacgtatatatataagggcgtagacgtccctcttaacagatactctgtagtccgtgctaacgtaaacacagcattaaaagtgcttgttacttcactattattagcattgaggcgcgtgtgctcggaaaacctaccatattataaaagggctaacaaatatgcctcaaacgcacgaaatgtccctgaacggcactcaatacttaaaatatgaacttaaagaccttgagtctcgagctcacgatgcaaagactccttcaacaaatgaattctatgatgatgtagaatcgcacggaacagaagaattagttgaagctaaactgtcgtttttgaacagaattgctgctggtttaagtgccgagacaaagggtattgaaccgattacagaagatgaaaaaactgatgattctatactgaacgctgcatctatgtggttttcagcaaatatggttctgcctgcttatgccattggcgccctagggcctatggtgtttgatctaaatttcggccaaagcgttttcgttattattttctttaacctcttaggcttggtatcagttgctttcttttctgttttcggtgcagagctgggcctaagacagatgattttgtctagatatttagttggcaatatcgcagccaggatcttctctttcatcaattttattgcctgtatcggttggggtatcgttaataccgtagcaagctcgcaagtcctgaatatggttaaccccggtcatcaatgtcctctctgggctggttgtatagttattatcggtgctactgtaattgtaacttttttcggctatggagtcattcatgcttacgagaaatgggcgtgggtaccaaattttgccgtttttttggtaataattgctcgtttggcaaggtctaaaaaatttgtccttggggagtggacatctggtcctactacagcaggtaacgtgctttcatttggatcaacagtttatgggtttgctgcaggctggacaacatatgcggctgactataccgtttatatgccaaggaaaacgaacaagtataaaatttttttctcgcttgtagttgggttagcaacaccattatattttactatgatacttggtgcagctgtagcaatggcagctatcggcgatccagcctggaagacgtattatgacgaaaattccataggtggtttaacttttgccgttcttgtccctaattctgttcacggattcggtcagttctgttgcgtgttattgtctctgtccactatcgctaataatgttcccaacatgtatactattgctttatcggtgcaagccacgtgggaacctcttgcgaaagtcccaagagttatttggactttattaggcaatgcggccgcactgggtattgccattcctgcctgctactatttttctaccttcatgaattacttcatggattccataggttattatttggctatttatattgccattgcatgttcagagcattttatttataggcgttccttcagtgcttacaatgttgatgattgggatagttgggaacgtctacctatcggtatcgcaggtactgctgccttaattgctggtgcctttggagtagcgttgggtatgtgccaaacttattgggttggtgagatcagtcgtttgatcggagagtacggcggtgacattgggttcgagttaggcggaagttgggcgttcatcatctataacattgtaagacctttagaactcaaatatttcggtcgatgactaaatgttaattgattaatatttttgctaatcattgaaatgattggttttaatggataaatctcgacattcgaatagatagcatataattcaaaaacgattataatgggatatatatataagtttaataatattaactcccttcccatttcttgaagagaagagatgtgttaactcctccaaatccgaagctgttgcataatgcgtacttcggattagctcccacaataggtttgtctcttatgaaatgtagcttatcggcctcgttattttctagagtcagaacattgtccaggtttaaggtatgcggcatcttatcatccttcaaggaacaaattgtaaatatactttctacggcgccagctgcacctaaaagatggccaattgcacctttgttactggatatgtacagtggcttgcttttggatcttcctggtaagagtgctgaggctactgccagacactctgctttatcgcctagtaaagttgatgtagcatgtgcattgacgtagtcaacatcagttggttctaatctagccatttttagagccatctctattgctcttttggcaccatttccatcagcaggaggggaggtaatatggcaggcatcactgcttaaaccatagcccacgagctcagaaattatgtttgcatttctcttttgagcatgttctagcgattccatgacaatcattccgcatccttcaccaagtacgaatccagaacgttgtgtatcaaagggtctagagatcccgtttgtagtaatcgactttgctctgatgaaacctgctaaacttaacggatgcaaactcgtttcacttgcaccggcgacacagatgtcttgcatgcctaaccgaataaaattgaatgcatcgccaatggagttattacctgttgcgcatgctgtggaaacactatgggataatcctctaaggttaaacttgatggaaacattaccagctgccatatttgtaaggattttagggacgaaatatggatttattcttttattgtcgttatggaattgtagagaagtttggtatatgtcttgaatggatcctataccagaacctatcaggcaaccaaagtgatccagattgcacagagatgtattgatggttatatcatttgggttcaagagaccagcattgtgaagcgcttcataagttgtacgtagtgctagcttgataaagcttgaggttcttctctcatcctggctagtgaacagcagtttattgatggctgaattttcgttttgaaaattctctggaatcttccccactgttatcgttgatgggatacttttttctctgagtttgtagtcctcattatagttgggcaaagatgtgattggtgtgagtccatttttggaagagagcagattcccccatgactcacttaatgatcttcccaacggcgttacacagcccaatcctgtgataaccactcttcttgacatttctttactagaaattaaattttaatccgttgtggctcctgtcactttcaagttgctaataacctgataacgtttaaggattttacttccttttttatcatttatttttctgagatgagacagagtcagaaataatagcacactatatgttttaaaaaaaaaaatctatctacgtatttatttaatcaataagatgtgattttataaatgtgtcgttttttagcatcattacttgttttgtggcgaatatagaataggactgtatctgagaattattactcaaatatgttcgattttagaggattaccatttcaacagatcgtccttagcatataagtagtcgtcaaaaatgaattcaacttcgtctgtttcggcattgtagccgccaactctgatggattcgtggtttttgacaatgatgtcacagcctttttcctttaggaagtccaagtcgaaagtagtggcaataccaatgatcttacaaccggcggcttttccggcggcaatacctgctggagcgtcttcaaatactactaccttagatttggaagggtcttgctcattgatcggatatcctaagccattcctgcccttcagatatggttctggatgaggcttaccctgtttgacatcattagcggtaatgaagtactttggtctcctgattcccagatgctcgaaccatttttgtgccatatcacgggtaccggaagttgccacagcccatttctcttttggtagagcgttcaaagcgttgcacagcttaactgcacctgggacttcaatggatttttcaccgtacttgaccggaatttcagcttctaatttgttaacatactcttcattggcaaagtctggagcgaacttagcaatggcatcaaacgttctccaaccatgcgagacttggataacgtgttcagcatcgaaataaggtttgtccttaccgaaatccctccagaatgcagcaatggctggttgagagatgataatggtaccgtcgacgtcgaacaaagcggcgttaactttcaaagatagaggtttagtagtcaatcccattccgaatattgtttttattgttttatgtttttccactgatctggtaaacactagctggttggcgctattaatatgaaaagagttagaccaaattgagtagaaaagaaacctttggcaatcctaactatgttgttttagcttgtgtatttaagcgcatatatatatatttctgaaaatgacaacatcaaaagaaacgaacttatttagaataaaaagaaacgacttggcttcttattattcctactttacgtcacgtgggaggcccgtttaggggggcagctatgtagtttttccgagcgtactttctttcagcatccgaaaagtcctcacttgacggcttacacggaaacgccgcggattgtggggcacagatgatgacgcagacggaacactgcagaaatctttttaccttgtcgttaaagacgatattagagagaagagtttggctggggacaaagtgccagcttttcgttcagggcgaggtgccaaaatacttgagaaggccaaaccccaaaggacagggccaaatacgtacgctacggtaatatctaatgggagagggtataacattgaccattttcgaaggaggcataggaatttagacgctgatggatgttatcaatattgaagtttttcaccgtttccctctttctctgctcctttaaagaacgcaaagtctcctcttgagagaaagcagacgattggaattggtatctttcacgtagcattgcttaacctacggccatattaatgatatgaagtcatatgaaaatggccgaggccagcggttcattcgaggatatatattttattacccggcgtctctagccgaagtaagaaaacacaatgcaaccagcgttggtggaagggcgtgataatgctgaatgggagaagaaagttgaatagtgactcttcaaatgtgtcctttcaggatgcgctactttcagaagttacaaagatatctgtatattgaatagaatttttttcaccactagaattgttcttggagccagcacaagcacttacaatggcagattattcttcccttactgttgttcaattgaaagatttactgaccaagagaaatctgtctgtaggcggattgaagaatgaactagttcaaagactgataaaggacgatgaagaatcaaagggtgaaagtgaagtttctccacaggaacaaaaccaggaacaagggtcagaacctgcggcgatagaagaaccagcctcccagaacattactgaaaaaaaggaagtttcaagcgagcctaaagaaacaaacgaacccaaggaggaaaataaggacgttcaaaagccctctgatggaccttctgctactgcttcagagaacgaacaagctgctgcttccactgctgctcccgctttgtcaccagaagaaattaaggccaaagcattggatcttttaaataagaaactgcaccgcgctaacaaattcggtcaagatcaagcggatattgactctttacaaagacagataaatcgtgtggagaagtttggtgttgacttgaatagcaagttggctgaagaactgggccttgtcagtaggaaaaatgaacctgaaagtggcaataacggtaaatttaaaaatagaaacaaaaatgcaaacaaccgctccagagtaagtaaaaacaggagaggcaaccgctctggttacagaagataaaggctcaagccgttttggtggagtttttcattctagtttcggttctttcccactttttaaacgaccgcagttgtttgtatatgaaggtgcaaaatttgttgcatacgtaaacatgtgtagattattctaaataaatctgtgttattaaatccgaagagtcggcggttcactgtattacacatacagtggctgtcaacgttgtaaagtgctagtagagaatgagcggcgagatttacagactgaacattcttgtacaagttacaatgatgatagaggaaaaataagctatgataaatagttcatagtaatgcaggtggggatgatgcaagcgggcctatttattttgaaatagtactgaatggtttggaaaaggtggaattttcaatctgcaacgatatcgcgctcaacatctttaacctgtcatcatcgtacgtatttgggacttcaattgaaggcaatgtaatgatagtgctatctgccgatgtgcttgacctcgtcactcgaggctcttctttaccgggagtgcttgcatctttcgttgaagaatgtgcactcaagacctcagatgtggagtgtggcctcattggattggactgtttattactacaaaccaagggatattgatggagtgtcatgtgatagataatttcgttgattggtgccaaagatgcatcaaacccataatctttgacaagagatcccagtatgagattcagcactctcacctgaattttttcttgtgataggtcagcgaatagttgacgtgtagcgggcataaatagcctttgcgatagaatagtcaaaaattcgattgatgacagccgttcagtaagatattgcttagtagaagacggtaaatgtgaaaagctgttttctaccacaagggaaatggaagccattagtgaatttttgcccagcgtttctagattagcaaaagaatccaaatttctttcatccttagacatctccaagcacgtccttgagttatgtatctttgacaggatgagttttctcaagttgttggatattacaactttgctttggcaccctttttttttcgttaaatttggtctaatgaacttatctctttgaatttgttcaggtagtggaatagcattatttacaatttcaacaattattgatttggcaataaagtcgtattcttgttcactttctagaggctgatcttctatatcaaacttttgtaatttttcatcgccgccgtgcgcatacggtgccgatggatcacgaagaagagatgcgttcttcttaagtaaagagcgaacttgagttggtacaggtggaagagtgcggccattcggataaggtaacaatttttgtgatgttatagtattaagagaaggaagagcgtgctcagcaggttcttccttcacgctggcttcttcgtcagagcttgatgcattggaagctgaacaagaccccatattacttgagctggggggagacaaaggaattttttgaactttaccacgggctattttcttcttagagtctaataattttttcttggaacgtttcctgtttcttctcaccgattgaacagcagcggtaaccaacttttcaaattctgccgaaaacgtatcagggtactcaaattcactccttaatatggtggctatttgtcttatattatcatcttgttcacttgctttgtgctggctcaagccaaatgagtcaatgagttctagtcttctgctagaaaacttcttccatttcttttcatcattaaagtttaactgagctctgattttatgtgtagtaccatagcccgtatactttcctgttttatggctaccttccaaatgaattttggagttctcagtatcgtcaatcatcttgcaatttttactctgactgttgctgttttttttgctgagatattttccggttaagatgtttgaatatgctaaaggtaatatacagctagagaaatatgaaaagcaagaatataaaaatagaacaggagcacttagttcggttttttgccatcatgtttaatatatatatatatatatatatatatatatatatatgtgcgtgcgtgtgtgtgtgtgtgtgtgtgtacatgtatgcggcagctaaaagatgacgagtaccttctaacggccatgttattttctacagaaagcatctcactttgagcgcccagaaaaaagaaaagggagaacaaagtgattaattttgcctctcgattacattatgaggtggcactatttgtcacattttatgtttttcatcccgcacttggctttcatgagaaaagcatgtaggacgcttgagtttggcatgcgagagaagaggcgtgtcagaaaaaaaaacgccttttgctcttgagaagagcggcaaaaattgccgaacaggtggaatttctcgaccaaaggtggggtaaatatcggttacccgtttgcgagttcctttacagtctcaatgatttccaagatgactaagggaatattttccatggtgccttttgcctcgcgtacactcacggcactaatgggcgatacgatactatgattgtgttcgggattagttcgattcaatcattcgcgcacgaggcatggacagaaatggcactgattttagtcaccgagtcaacaaaaatgaggcgactcgatcaaagatgtttattgactcgtttttgcaactagagaaaggcattcttgcacggagagaatgttgactttagttggagtaccattagagagatgccattagagaacattgtactgcagtaacgatgagtttaagtttttaagtacgcatgtttatatatgaaaaaaatatacattgagattacgaatatatatacttgtcaggaaatgccggcagttctaatggttaatccttgtcctatttctttacgccattttctttgaattgatcttctgtgacaccggttcccatagcagctgttgcgctaacaccaccttgagctaacttcaataacccatcgatgtactccgcaccagaccatttttgatgtttcaacacatcaacaccatcgtccatttccctctgctgaacattctgggcataagctttcatcccatccttggcaaagtcacgagagaagttatggacagctaaagcgttagtgtgtaaaccggccaatgtgataaattgccagatgtaacctagatcacccagcctttggatgaaggtgtgttgttcatcaacggacatggcttttggccagttaaaggatggagacaagttgtaagctagccattggtcagggaatttctctttaacaccttctgcaaactccttggcctgttggaagtctgggtagttagattccatccataccaaatcagcatatggagcaaatgcacgggccctcatgatagaacattgcgtcccacctctgtaacggtacaacccttcccttacgcgtggtagctcccagtcgaagaaaatttcgtggccaagaatttctttagcgagcttcttggcttctctgtgggatgtttcagtcaatggacccactttagaggtgaatttcttaatcaattcttgcttatttgacagggctgatctttcaatttcatcaatgacggcttcatggaataacttgagtccagcgtctctacaccatttttgttcaatgtcagctagttcttgtcctgatgcaccactcatgatggcatcatttaaaacttcggcaaatggctcgatatttggattggtggcaccgacaatgaaataatgatctctggtatcgatggttgagctaatcaaagtggctgcttctgaatcagtcctagcaacgacaattaagtcagaatgcatgatatcagcacacattctaatagtcaccaatctgttaacatgttcctgaacgggtataacacatcttcctgccatatgcccacatttcttatttgtagatgtctggtcttccatgtggatcccagcagcaccacgctcaatgaacatcttggtcaatttgaagactgcggttaaaccgccgtggcctgcgtctgcatcagcgacaattggtgttaggtagtcaattggggcacccatctcatcgagttcttcctgagatttagcctttgaccgtgcctctagttgttttctgtcgtgaaacaattgggccttgaacaaatgttccactttgtttggaacggtgtccattggataatcagctaagtctggaccaggttcatttgaggtggaagcagttgatgaacactgccaaccagaaatatagattgtgtctaagtattttgccatttgagaaatctggacaggatctagggcaccgaaagttttagagactgtaccctcattgtgatgcttctctaataccttgaataattttctggccatgaccgaagatgggtattcgattggtgggaatgtcccgcgtctaacagcaatatctctggctgaataatttctcttagtcttactccaacgtgagtcagaccaccatttctcaatttcggcagcatctgcatctagttttgcttgtaaagctgcaaaatcgttcttcgtatttccaacggggataggcatttttcgttgactttttgttatgttatgctaagagttttctctcaattgttaggtatttgggtgtgaaaagaaaaaaaggataagatgaaattagcaagccaagacaaataataagaattttgccagtgaagcagctcctttatataataaagaaacgttttgtgaattccgatgtgcctggttaagggcggactttggactgacttatgcttttctcttttgcaccaatattgagtcacatactgggatgctagtccggactatggatattttcttctgtaaagggtagtgaaagatgacgttgagtgttaattttgtggtgattggcttcagttttgattgtttcggatgaaatgaaaaagtgacgaagtcagataagtgatcgctcggatgaatggaaacctggggcaaaagggaacagtttttctcatcggatgacgagtagcaaaacccgaccgcccaaagcatccgggttacgagatatttacttttcaataaatagattcaattattattattttctcgagacatattactgacacaagaaatttcctatgggagcttgatttagtttttccttctaacattgtcattttaactgtgttgccttcccttgctcgcaactatgctacgctatattgtactcttgaattttatttatgttttgttcccagcgggcatctttcaataaaatgaactcaagaagaagtaaataataacaagctataatgggtggccatttgtgatcaaatttggagtgaaacacgtatgattatgtttgaactctctttctttgatacgaaacctcaagcgacgtaggtgatggatatattcacaagataacaaaggccgtgttacaacattagatatgtaaacaacgtgctagaagttctcctcgaagatctcgaaatctacaaaagggaatcgatattttatacataatcctattattattttttcttccattttatatgctcactcattatcctttacatttccaaaatcatgcatttcagcttccattaaattttgatggctgtctcttaattttgttatctttctttatgtcatcctcttacagagtatatggtaatatactagtaatatgattaatagtcgataagtgagtgtgaatttttattccgaaaaatatatgacgatgatcacactatattttctagaaataacttaaaccatagtgaataagaatctgtagtgctccttgagaactaatgaaattgcgctaaaaacaaacctagttaacataatgtttaggccaggaagaatctaaatacaaaccttatcagtcccagcgtacgcgtcatttacatttgcgtattgaaaatgaaaaaaaaataattcatttgaagcactactattacaaaatttattccagcccaacattcagtttggaagcatcaaacggccttcgaccatatgaagatattccagtaaatatggtctccaagcagttcaactacttttcatgaatgtagcattttcaaggcacctctaacaataaaaaaaacgacaccagcaggatttgaaccagcgcgggcagagcccaacagatttcaagtctgtcgccttaaccactcggccatagtgcctatcattatgaatttcccaaaaaagaaccactatcagagacatataaaaataagaacacatccaccgatatctgttacaatgaaaccctaaaatatcatccatttggggtagtattcatgctaccagtatatcctgtatgcgtaatattatagccttttccaacagtgcacccaaatataatcacaaatcacccaattctcaaattcacttgttaaaatgaaaataccaaagcctcatcataccgttctattgtccatctccaacacaaaagtaccataataattttccgattcgacacgaatacagatagatgggcacatggcaaacttagctcagtatgggcttgtaggttgtaaacgagtcagaaatttcaacaataaaaaatacatcagatagtgtttcgatgttcttaattacacgtgaattatcaaaaaccatcaacataccagccaacatcagtgtaggtggaataaaactttcttaccatgtacagtaaatggaccatgacgccgtgcacaagcttatgcataatgagctaagcgggaagacattttcaaactacgtgatagttccgactgccctttcaattgctaatgtagcaatatgttaggaatgcaatattccaaaatgctgtctgtgtcagtgagaataacaaaaacattgaataaacttttctatggtaataaccacgccagataagggcgttgccatcgttttcatttttttttttttttcaaatggtggggtcaccgttgtgaaaagaaacctttgattctcaaccatatcggtactcggactaatcacttaaatctttccaagggattatcgagaatgtcatagtgcaaaataatcttagctttcaataattttttcatttggagtcacactcccgttaaaacctagtcaacggcttccacttaaagctatcaacaaggggcaattgattttgcattttcgtctaaatgaaagttgcagccagcaatttacccgaagtttaaataaatcaatgcaaaccatgttcaacttaaacagcaatcgctttctattaccttggaattatatcagaacgtctatctgcgaagctttaataaagtactggaagttgtgtctgaaatgtctgttttggtaaatttgtttgatcctgattatacacctcaaaggaccacgttaagtggccatatgacgagtgttattgcgtgcttgcaagttgaagataattatgtcattacaggaggatgtgataaaacgatcagagtttataacttagtaaataaaagatttcttttacaactatcaggtcatgatggtgaggtttgggcattgaagtatgcccatggcggtattttagtcagcggttctacaggcagaacggtgcgagtttgagatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatacggcgactgtaagaactgtctcaggccacggtaatattgccattagtggctcctatgataatacattgattgtgtgggatgttgcgcaaatgaaatgtctatatatcttgagtggacatacggatcgtatttattcgacaatctacgatcatgaaagaaaaaggtgcatctctgccagtatggataccactattagaatttgggatttggaaaatataaggaataatggagaatgttcctacgcaacaaattcagcatcgccatgcgccaaaatacttggtgctatgtacactttgcggggtcacagagccctagtcggtttattgggattatccgataaatttttagtcagtgcttctgtagacggttcaataaggtgttgggacgctaacacttactttctgaagcactttttcgatcacacgcagttgaatacaatcaccgcattgcacgtttctgatgaggtattagtgagtggatctgaaggtttgctcaatatttatgatttaaatagtgggctgttagtccgttcagatacattgagtggtgctgataatgtttggaacgttagttttaaggacaacacacttgtggcagcggtagaacgagacaagcgaaatcttttagaaattttggactttagttgaagattgatgtgagaatgatgcagaacttaccttgtcacgtttggaactcagttgtactttttcggtgtaaacaaatataaaactttagaatttacattaataagttatgtgctatttattagtttaatatatcaacattaattacatgcgagctatgtattattagctcaatcagcaggactaaaatcgaggaaaaagtaattttgtttatgcccagttcagttatcgtccatttgtagcaaatgtggtacaagttgacccatattttcatgcattgggccatgcagtaattatcacactcactttgtcataatgtatacaatggccgcttatttgcgactcgtctcatatttttcctgaaactgtagctgtgtgtaatattattcattaacttcgataattcggctacagaagacaagagctacatccttactggtgcgaataaatgacataatctgtcaagagtaccgaagtaaaagcaacgattgccgaacacatcttcctgaagtatcatatgccaatacaaggtttcaataggaattatgaaagcggcattatcacccttaatctgaaatatgtaatgatgacggtgcagtatgttgactacattgtaaagttgcactttcactcaactcatgaaattgatgacattaatcctacgtgacttacacatatgccatgaacgaagaaggtggcaccaaaaatccagcgtttccgatatacacgcagtcaaatgttcagactaaactttggtattctgacaacgtgttgtcatacctgttacgagccagaaacgtatttctttttgggtgatacaatctccagatgactgctttttttttttttaccccagattcaggggccgaaggaacggaaatgcggtgtggcgagattgcggatgtgctaaaaaataatatcctcgaggcaaccagcataatgtggacggctctcggcaattgacttccataacaaatgcatcctgtaatcaggggtattataagttactgtatggttaattaaatatagaatgaaaggggcagcgttcttaaggggtattgctgggtggaaaaatacaagtgtctttacttgattgtgtgcacatatataaggcaaaagatttctagcgtatatttgaatcttttgttcttccacgttcaaatttctttggtcaaaacatttcataaagggacaagttctgcattgtattctaataattgcccatagaacatataaattaggtatcgactgttttcgtctccactttaaatgacaaagaaggataagaaggaagtaaaagttcaaacggttaccacggaggatggtgaaaccgtgaaagtttttgaagacctgcagggttttgaaactttcattgccaatgaaactgaagatgatgatttcgatcatttgcactgtaaattaaattactacccaccatttgtgctacacgagtcgcacgaggaccctgaaaaaattagtgatgctgcaaattctcattctaagaagttcgtgcgtcacctgcaccagcatattgaaaagcatcttttgaaagatattaagcaagccgttaggaaacctgagcttaaatttcacgaaaaatcgaaggaagagacatttgataaaatcacctggcattacggtgaggaaactgaataccatggtagacctttcaagatagacgttcaagtagtttgcacacatgaagatgctatggtatttgtcgattacaaaacacatcctgtaggcgcaaattaaaggttgtgtcatagagaatgtgttagtactgaatcctaacctcccaaattcataagtagttttatgtacctttaatgatttacgattagcaactttttgaattttttttattgaaatgttgagcccgaagacgtgaaacgctataaagtagtatcactgttacgccgcgaaacctgataatgtattgttaaactactacctggtcgatgattatatcgacgcttctaaaatgaatgctattacccgaacttccacttgattgccgtctcttcccgggtaacattgtaagtgtgaatatgatttttttttttgctttctcttttcaaaatttccgaaaagcatatcaagacgtgtactacatacagtaaaagccctcctagggttttcagtagtggttcgaatagtatagattactgcttttgttactctgcaacaatcccaaaacttaataaaaagtacaaaagaccaaataaaagtatcgtatataatccagtcataatgatgaatccacacgttcaagaaaatttgcaagcaatccacaacgccttaagcaattttgatacgtcatttttatcggaggatgaagaagattattgccctctttgtattgaaccaatggatattactgataaaaatttttttccttgtccctgtggttatcaaatttgtcaattttgctacaataatatcagacaaaatccagaattaaatggccgttgcccagcatgtcgtcgtaaatatgatgacgagaacgtcagatacgtcacattatctccggaggagttaaaaatggagagagccaagctcgctaggaaggagaaagaaagaaagcatagagaaaaagaacgtaaagagaatgaatatacgaataggaaacatttatctggtaccagagttatccaaaagaatttagtgtacgttgttggcatcaatcctcctgttccatacgaggaagttgcgcccactctgaaatctgaaaaatattttggccaatatggtaagataaataagattgtggttaatagaaaaacaccccattctaacaacacaaccagcgagcattatcaccatcattcaccaggatatggcgtttacataaccttcggatccaaggacgatgctgcaagatgtatagctcaggtagacgggacgtatatggatggccgcctgatcaaagctgcctacggtactactaaatactgttcttcttatttaagaggattgccatgcccaaatcccaactgtatgtttttgcatgaacctggtgaagaagctgattcttttaataaaagagaactccacaataaacaacaagcgcaacagcaaagtggcggaactgcattcactagatctggaatacacaacaatatatctaccagtaccgctggttcaaataccaatttactaagtgaaaatttcacaggcacaccttcaccggcggcgatgagggctcagttacatcatgacagccatacaaacgctggaacaccggtattaacacctgctccggtccctgcagggtcaaatccttggggagttactcaatcagcaacacctgtaacctctatcaatctctctaaaaacagcagctccataaacttgccaacattaaatgattctctgggccatcatactacccccacaacagagaataccatcacaagtacgacaactactaccaataccaatgctacaagtcactcccatggtagcaagaagaagcaatctcttgctgcagaggaatacaaagatccttatgacgcactagggaatgctgttgactttttggatgcaagactacattctctatcaaattatcagaagcgccctatatctatcaaatccaatattattgacgaagaaacttataaaaagtatccgtctttgttttcttgggacaagattgaggcctcaaagaaaagtgacaatacattagccaacaaacttgtggagatcctggctataaagccaatagactacactgcttctgtcgttcaattcttgcagagtgtcaatgttggtgtaaatgacaatattacaatcacagataatacgaaaactcccacccaaccaataagactgcaaaccgtctcacagcaaatccaaccaccattaaacgtcagtacccctccaccgggtatctttggtccacaacataaggttcctattcagcagcaacaaatgggtgatacaagctcaagaaattcctctgatttactaaatcaactaatcaacggaaggaaaattatcgccggtaattaatccgactctaaatatttttcttgtttgcattaaccataattttatctatttttatttctcatgaatatataatctctccgtttataacgaaatgcaagaaaaaaaaatctcacccatttttttaaacctttgacgtggaaaggtatctgggaaaggtatctggctaatgaataatgccatagcatataccagtatagtctatttactcgttacaacgtatgaaagcgtcagcgctgcaagaatgactaattcatagaaaataatcatcatgatatatatcataatgcacggaacctgcttcgctaattttttcacttaaatcacattttttcaacgaaatctcttgcgcagttggttggaattcttatccgaatgactcagtctacatcaaaaaactgtggccgaatggtggtaattgatgactcttctatttttttttttcatataaagagcttgcgcgcgtgttgttgttcgctatccatttccattaggaacatttttggatattatttttcagacccgtaatatacttaacacatataccactaaaggcaaaagaaagagagatctgaagtgagaaataagtctgcatcattatgccatctgctagcttactcgtctcgacaaagagacttaacgcttccaaattccaaaaatttgtgtcttcattaaacaaatccaccatagcaggatttgcatctgtacccttgagagctccaccatccgttgcatttacgagaaagaaagtcggatactcaaagaggtatgtttcatctactaacggcttttcagctactagatccactgtgatccaactgttgaacaatatcagcacaaaaagagaggttgaacaatatttgaaatatttcacttccgtctcacaacaacaatttgctgtgatcaaggtgggtggtgccattatcagcgacaatctacacgaactcgcttcctgcttggcatttttgtatcatgttggtctatatccaatagttttacatggtaccggtcctcaggttaatggaaggctagaagcgcagggaattgagccagactatattgatggtattagaatcacggatgagcacacaatggccgtagttagaaaatgttttttggaacaaaatcttaagctagttactgcattagaacagctaggggtccgtgcaagacccattacttctggtgtttttactgctgactatttggataaggacaaatacaagctagtgggcaatattaaaagtgtcacaaaagagccaattgaagcatctattaaggcaggtgccctaccaatcttgacctctttagccgaaactgcttctggtcaaatgttgaacgtcaacgccgacgtagctgctggtgaattagcccgtgtttttgagcctttgaagatcgtttacctgaatgagaaagggggtattatcaatggctccacgggagaaaaaatttcgatgatcaatttggatgaagagtatgacgatttaatgaagcaaagttgggtgaagtatggtaccaaattaaaaattagagaaattaaagagcttttggactatcttcctcgttcttcttcagttgcaatcattaacgttcaagatctacaaaaagaactgttcactgattctggtgcgggtactatgatcaggagaggttacaaattagtgaagagatcctccattggcgaatttccatccgctgatgctctaagaaaagctcttcaaagggacgctggcattagttccggtaaagaatctgttgcttcttatttaagatatttggaaaactctgattttgtctcttatgctgatgaacctcttgaagcagtggccattgtaaagaaagatacgaacgttcccacactagacaaatttgtctgttctgacgcagcctggttgaataacgtcacagataatgtattcaatgttttgcgccgtgattttcctgctttacaatgggtagtcagtgaaaatgatgctaacattgcatggcattttgataagtctcaaggttcatatctaaaaggcggaaaagttttgttctggtatggtatcgatgatataaatacaatatccgagctcgttgaaaattttgtgaagtcgtgtgacactgcttctaccctcaactcatcagcaagtagtggagtatttgctaacaaaaaatcagctaggtcgtactcaactagatccactcctcgtcccgagggagttaacaccaaccctggtcgtgtcgcgcttattggtgctagaggttacacaggtaaaaatttggtatctttgatcaacggccacccatatttagaagtggcccatgtttcttctcgtgaattgaaaggtcaaaagttgcaagattatacaaaatccgaaattatatatgaaagtttgcaaatacaggatattaggaaactggaagaacaaaatgctgtggacttttgggttatggcattacccaacaaagtctgtgaacctttcgttgagacaatccaaagtgttcatggtaagtctaaaattattgatctgtccgctgatcacaggtttgtatcagaatcagactgggcttacggtttgccagaattgaatgatagagcaaaaattgcaaacgctgccaaaattgctaatcccggttgttatgctactggttcgcaattaactatttctccgttaacaaagtatatcaatggtcttccaactgtgtttggtgtttcagggtattcaggcgcggggacgaagccttctccaaaaaacgatcccaaattcttgaacaataacttaattccttacgctttaagtgatcatatacacgaacgcgaaatctcagctcgcattgggcacaatgttgcattcatgccccatgttgggcagtggtttcaaggtatctctttgaccgtctctattccaataaaaaaaggttccttgtctattgatgagatcaggaaattatacagaaatttttacgaagacgaaaagctagtacatgtcatcgatgatatcccactggttaaagatattgagggcacccatggtgtagttattggtggtttcaagctgaatgatgctgaagatcgtgtagttgtttgcgcaaccatcgataacttacttaaaggcgccgctactcaatgtctgcaaaatattaatcttgctatgggttatggagagtatgctggtatccctgaaaataaaattattggtgtctgatcactgtgtatagtagatctgcagctcagtcacatgagacattaacgtatataaatatataaatatatatatatccattaaataacgaagtaggacatggtctaaaaatagtgcttctcatgtattgattttgagtagccataagaataattattgatttcaagatctttgatctccttacatccaaaattataataccactttatggtatcacgacatcaccacaacagagaaggattgccgcatttggatatcgtaaacaaaggcgttaccatagaaatgtactgattggcagaattactcttcaggagaatctttcatacaaaggaattccattggggaaaatctcgttaccaagtcaatgctgaactttctatggcctttgtttactatcgttaattattttacgaccacttctgggtagaaatatttcgtagccctggaacgagcttgtttacgcgttttatcccattatatggcacccaaatcaaatttaaaaagaaaaaacgcgtaaacagtgtcgggtaagttcatcctctgttactttaattgcttctttttttgaaattctaagtaaacgcgtcattttgatcctcaggacacagaaatccttgcagaatcttattgggtgttgaatagaggacgcgtaaaaacgatatggaaatttttttcatatagtgtagaaagaataggttggcgtaggtagtttcgtgtttgatagaaacctccaacaaagtctgcagctcacgttttagaataacaagtttagagtttatcttgttgcctttgttaagtcagtaccattgaataaaaattatataaaggagctaatatttcattgttggaaaattactctaccataattgaagcatatctcatccttttcatccttttcaacgcaagagagacaccaacgaacaacactttatttgttgatatattaacatcatgtacgtttataaaagagacggtcgtaaagaacctgtccaattcgataagattaccgctcgtatatcacgcttatgctatggtttagatccaaaacatatcgacgccgttaaggtcacccaacgtatcatttctggtgtctatgaaggtgtcacaacaatcgaactagacaacttagccgctgaaacatgcgcttatatgactactgttcatccagattacgccaccctagcggccagaattgccatttctaatttacataaacaaaccacaaaacaattttctaaggttgtcgaagatctttatagatacgtcaatgctgctactggtaagcccgctcccatgatctctgatgatgtctacaatattgtcatggaaaacaaggataaattgaactccgcaattgtctatgacagagattttcagtacagttattttggttttaaaactttggaacgttcttatttactaagaatcaacggtcaagtggccgaacgtccacaacatttaattatgagagtcgcactaggcatccacggtagagatatcgaggctgctttagaaacgtataacttgatgtctctaaaatattttactcacgcctctccaacgttgttcaatgccggtactccaaaacctcaaatgtcctcttgtttcttggttgccatgaaggaggactctatcgaggggatttacgacaccttgaaggaatgtgctttgatttccaaaactgctggtggtattggtctacatatccataacattcgttcaactggttcttacattgctggtacaaacggtacttctaacggtttaattcctatgattcgtgttttcaataacactgcccgttatgttgaccagggtggtaataaaagacctggtgcgtttgccctttacctggaaccatggcatgctgatatatttgattttattgatattaggaagaaccacggtaaagaggaaattcgtgcaagagatttgttccctgctctatggattcctgatcttttcatgaagcgtgtcgaagaaaatgggacctggacattattctctccaacatcagctcctggtttaagcgattgttacggtgacgagtttgaggctctatatacccgctacgagaaagaaggtcgtggtaagactatcaaagcccaaaaattatggtattccattttggaagctcaaactgaaactggtacacctttcgttgtttacaaggatgcttgtaacagaaaatctaatcaaaaaaacttaggtgtcatcaagtcatcaaacttatgctgtgaaattgttgaatactcagctccagatgaaactgctgtttgtaacttggcttccgttgccttaccagcattcattgaaacttctgaggatggtaagacttccacatacaacttcaaaaaattacatgaaattgctaaagttgttactcgtaatttaaacagagtcattgatcgtaattactaccctgttgaagaagcgagaaaatccaatatgagacatagaccaattgctttgggtgttcaaggtctcgctgacactttcatgctgttacgtttgccatttgattctgaggaagcccgtttgctaaatatccaaatctttgaaactatttatcatgcctccatggaagcttcttgtgaactagctcagaaggacggtccatacgaaactttccaaggatctcctgcttctcaaggtatactacagtttgatatgtgggaccaaaaaccctacggcatgtgggattgggacaccttaagaaaagatatcatgaagcatggtgttagaaattccttgaccatggcaccaatgcctactgcatccacatcccaaatattgggttataatgaatgtttcgaaccagtcacttccaatatgtactcccgtcgtgtcttatccggtgaattccaggttgtgaacccttacttactgcgtgacttggttgatttaggtatttgggatgagggtatgaaacagtatctgattacacaaaatggctccattcaaggcttaccaaacgttccacaagaattgaaggacttatacaagactgtttgggaaatttcacaaaagactatcattaacatggcagccgatcgttctgtctatattgatcaatctcattctttgaatttgttcttacgtgccccaactatgggtaaactaacaagtatgcatttttacggatggaagaagggattgaagaccggtatgtactatttgagaacccaagctgcatctgctgcaattcaatttactattgatcagaagattgcggatcaagctacagaaaacgttgctgatatttccaacttgaagcgtccatcatatatgccttccagtgcaagctacgctgccagcgatttcgtgcccgcagctgtgactgcaaacgcaactattccatctctagatagctcctcggaagcttcaagagaggcatctccagctccaacaggtagccactcattaactaaaggaatggcagaattaaacgttcaagagtctaaggtagaagttcctgaagtacctgccccaactaagaatgaagaaaaagctgcccccatcgttgatgatgaggaaaccgagttcgacatttacaactctaaggttatagcatgtgctattgataacccagaagcttgtgaaatgtgttcgggttaatgagggctaagtttttatttcttcaattctatttatcaaaatttgggtgtttacttcgaggtgtaatttatattttcttttgttttctctgataaaaaaattggtttccattctaatgccaagctaaaaggtacctatatatgtttactaattatttttctactttgcatatatacataaaaaaagtcgaataatttaacatgaacattttaagctgtccttgtaagaaggccatgatacagattcccccctgccccgaaatggggtctaggcaacattgttctataaaggaacgcaactttatgtggcaacattaaagcaaatacatatctacttgtgaagccaaagaattgtaattaaatagcactcattattatttttgtcttctagtttatagttgaatataccatcttttttagattcccaggatgcgcctatatcgttcttcaatgagaaattagcgttttcttcgttgagtccttcaatgttcaacgtcgttaccgaggcaatatatttatacaaagaagagtgcttttcaagtttttctaggaccagttttataagaaggttggaagttgattcggtcgataaattgatttcattgtcatcttttaaactatcataactttcttgaattaacgtaactagttttctttcgggcagaggagagttatcactccttccatcctttatttcaatctgcatactcatttttttgttgactttcgtaatcacttactttcacttatcctaaataatttacagtgcgttttgtaaaactgcaagacggtatccgctaatagagagaagaatacgtattttctagtaaagaaatttacaaaaaaggaggtatattggcatcgctattttcggatagaatggcaagagcgattaagtatagcaaactgggaaatgtatagagacaagaaataatgagactctctcttcaagtatctttgagcacgtatcagataactaatggttatatcgcttgttacggtcggtgatacttcactttgaaatagatattagcacgtgtctcggagagaagaaaatgaatgctgcattatacaaaatagataacagtatttaagagtccatatttccataaccagcgacttgcatacacgtaacatacgatttactacattatcgaatacgattaaacactacgccagatttccacaatatgtcttcagcaccattattacaaagaacacctgggaaaaagatcgctttgcccacacgagttgagccaaaagtgttctttgccaatgagcgtacctttttgtcgtggttgaactttacagttatgctgggaggccttggtgtaggtttactgaattttggtgacaagataggtagggtcagtgcaggactatttacttttgttgccatgggtacaatgatatacgcgcttgtaacataccactggagagctgctgcgattagacgtagaggatcaggtccttatgatgacagattggggcccactttgttgtgctttttcttattggttgctgtcattatcaactttatattaagattgaagtacaatgacgctaacactaagttatgaaattgtaattccaatatcgtaagcgtgggttacgcacaaactgtattttcaagatgctcacaaataatttagtttcatatatacgcatatatagaaagtatccatctataggtaatcatgaacaataaaaatattcacgtttcaggagctattgtttgtactcattacgtttttggatatcaagttgaaaatcagcccctttcactagatatcaagcgctataaaaaaattttaatttcgatgaggcatctttcttttctcttgtggctatgtaagcctaagaagccgtttacacatcaatgataaataagtatacaaaaagggttccattttttttttggccgctaccggactagcaagggcctaatggtacgctgagcgtagtacaaccaagcgcttgttagccgtagagttaagctcttgactactattacggtaaaagccgggaacgtgcgtaacaatttttttttgcattaggttaaagaggctcgctcgcggagcctttagaataccgcttaaggcgccaaaagatggaagctattctctttcttttttttttcacaaactgagaggggttgtgtatcgttaaaaatgttggaagacttctgactcatcactacgcagattgttagagtttttcgatgagaatggcttcaaagaacagaacaaaacacgattatataagccccatgtaaaaagaacgtcttaatttattttgaatttaggacttcttgacatttttagcatatataacaatacgataagtgtctcatcaaacgtggttaagacagaaaacttcttcacaacattaacaaaaagccaaagaagaagaaatgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaaggagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttgaagtaactcaggcccgagttgactgctcattgaaggtatgtatgataaacattatagaataatgaaaaatgcctcgtgacatacagataaaatctaacaaggatatattcaaaaaaaaaaaacaaaacaaaaaaataataacgtgataaacattaatgaacaatgtatttacattcttaagcataggtgagaaattaccttctttacttttttttttttttttggtgatattgtatattaaaatatatagtaatcaaattcgtttcattgatcaaattgctcactagttcttttttcaaaaatttcatctttataggtagatacaagtgccagagagatatataaacagaaaactctatcgatgtgataatgtatgccattatcgggactgtacacccacacatttacaagcccacacatcctacaactttcttttcatttcttgcgcttcttccactgtcataaaatatgattgtccgatgccgcagcctacgcctcggcgagtattcatcacctaagcgtcctgtaggcggggccacgcagtcactaacggaatactccagaaggctgcttcctttggaaggaagtttcactcggttgtccacccagcgctttaactttgtctcagcgaagaagaattgaataactatagtgaatttcaagagctagaggatggttaggtattagttcaaaacaaagatttcaagaaaccaacatagattaagcagaaatggtatgttaaaaagtgctcagatgaaagatgacgtcccatattccatgttaaagttgccatgagttagtataaaaggcaataaaggtaccataacgagaaaagaaagtaaaagaagaaatgttttgcaaatttaaggtggcgtaacagcaactattggctaatatattaatggcaatcattgtgaaaagaaatgtgaaatccgtatcgtaattggttaaatttataactcaaatttaaacactcgaatagctgacccgtaatattttatcccgctttaagagttcaacgctaaaaaatgatatctagctaaccattatgctacaggaaccttttttggactattatccctatcatgaaaactggaaggatctttcaaggacgccatttccaaagatttcccccacactggaacctattttactaacaatttttaaaatggttttttacctaaattgttttttctcagtctgacgctgttactatccgtactagaaaggttatctccaacccattgttggccagaaagcaattcgtcgtcgacgtcttgcacccaaacagagctaatgtctccaaggatgaattgcgtgaaaaattagctgaagtctacaaggctgaaaaggacgctgtctccgttttcggtttcagaacccaatttggtggtggtaagtctgttggtttcggtttggtctacaactctgttgccgaagctaagaagttcgaaccaacttacagattagtcagatacggtttggctgaaaaggttgaaaaggcttccagacaacaaagaaagcaaaagaagaacagagacaagaagatcttcggtactggtaagagattggctaagaaggttgctcgtcgtaacgccgattaagcaaactaacttcaaaacgttaaatcatttttacggattgtttagttttctatatataaatatgtgtatctttttccaataaaaaatataatcaataattttaagagatccgtggattcatttcgtaatagaaaatctcggaaaaatggtacagaatattgttggctaagtgcttcagattgcatcatcagaaaagtaaaaatacccccgtaatccatcttctctacatttaatctcatagtgctcgtaatgtctcgaaatttgtctttcgtgatcattgcacagtcttttcatttgtcacagtcacgtgattacatttaagtacagtatatccaaaaaattagctggactgggagccttctcaataagttggcggtttatatactcaaacctattaataggaaagaactcacaaaagaagccttttggaagagaaaactttgatatagaggggatatggtactgtttggactaggtagactattttacgtcattttattattgattaatgccgttgcagtactgagcgaagaaaggttcttaagaagaagtatgtaaacaggagaggcaaccataaacaacttattttaaagcaacaattaatactaactttattgaatatgctaatacattatttcaccgatttttgcagttggccttggaagatcaaatgatgagacacctgtttttggtcaggatcaaaataccacgaagtccaaggttgttcaattgattggcgccgtacagacattactgaggagtatgttatgttgatggagaacggttaaagttacatttcatcagttttttcccgttctttttcaccttttgtgagaaaattttactaacgtttcgtatattattcttgtagtaccattaattggaataaatatactggtgattgtttatgaattactattgggatgaactaagcgtacgaagcaaatattacatactactatatacaagaaacaggctctaatagtttttttttcccttcaccttttcggttttagctttattataaaagatatgaacaaaacctccaagggtagtggtagcatggtatgtgaaattagagagttcatgcataacttgaaatgaaaataatactctgttacgtagctaactactgccaaatatgtatcgaaaatatcaattattaaggggtttcgtattaataaaatagagatcaaatacattcatattagcctaactattgtggcaattctttcaacttatcatccacgaatgtctgcaagatctctaatttttcgatttgttcaattaatgcacttaatgatatattgtccttgttacttccatcaccatccgttctctctgttatgtcatcaagacgtaatctaaagtaaaatagcaagcagtcataaatgaaaataaattgattaatgttctggaccatggatattcgttcctttctaaaaatattaattgtccatgaaattggatcgaataactttgccgggtattttaatttaacaaactctttctgcaacatttcaaacatttcgaaattggatagaatggaatcaatggtacacaaagtaccagtccttccacaacctgcggaacaatgaaccaaaatggtaggaagttggtcgttttgatagtaatttctggcaaatagtgtatctattatgtgattcttgacattgattgcttgtaagattgagataggattgagtaaagtgcccaaatcaggccaatttttcacctgaatctgtaacaattcataaggtttctcttgatcatgatatgttagcagaatttgtcttatgagaattgcgtcatcatcatcatcatcatcatcatcacaagcagcagcagtaacaggaatattactattgttattgttattattattgttgtcattatcattatcattatcagtactatagttactactatttccctgaacaccagctgaatataaactactattttgtgttcccatagtatttttcctcatgctagtagtgctaggcatctttaatatttttttttctaacaatttaacgtgaataccgttataattaccttcttgccaatatcgataacatttctcaatgccattttcgaaatcatttgtcaatgagagaaccaacggaacgccattattcaatatgcatgtataaaagtcatgtacagtggagggcattggagcttgcgtcgctatatagcgcactcttcttgttgtggttgtagttgtttgaaatgacgaattttgctctacagaaaaccttggcagagacaaatagtttgcgttgatataattgtcgaggatgccaccatcggaagtagaatgtgaatgcttgataccttttgatgattgcaaacctttttttagaatcactctcgaatgctcgtagggaaaaatatccttgtacctgttcttggctcctaattcaacgcctgatgatattataacgtcatctgactccgaatcggaatctgattcaaggctgagcatcgatttatatttactgtattgagtgaagattggctgagaatgcgacctcttttgtactttgttcacgtcaggaaattttggaggcatgattgttgaagaagaagttgatgttaactgttcaggatatgatgatggcttttcaagtataaacgagttttccttcttcctgaaagagacagaatggttcaagcgccttttttccaaaaaatctaatttttgaaactgagaaaccaactcgatcttgggtattgacatcagatgctggaaccattcaggtataacggagtcaatgacctccttttcgtaatttttgctcaggttttcgtatctgatctgaaaccctagtttgtctttattagtgtccttttctagagaattttggttctttgggaattggaagttttgtaaagattttttggcagaatcgttattataccatctttcatgttcttctttgatgttgactgcactcaaatacgtctctaaacccattatttcttcattttgcgaaaatttgaacatttggtttatgtttgtttgtggtgcaggcagctggaacttaaataaggcagatatgggggaagaagaagacatgggagaatctgataggacgttacgcggagagggagaactggaaaagtttgaatgatctgacctactatcgtcaggaactttcaacttaaggttcatttgcggagacgatagtggtgttgtcgccgtcatatgcggcgctgtgttgtgtagactgttcataaggtttgtcttggggcttttaggttcagccgaactaatgcaatctgagttaaatgtgttggtgtttatatggtctggaaatagaattttgaattgaggaaaaccacacattagtatagacacggtttttttaacattagtatcaaactctattagcttggacgctattccataacaaggtaaagaaacagaactttccgtttgatttgcggtgctatcataaatgataatccgaaggttatcgatggccagtttagatttcaacacgctttgctcgctaggagttaagttgtccaagagtttggaaaaggtgaaatttttcctcctcagcagcgtggaaggcaaacatacatgaatggagtttgtgataatggatttggcatgttcggtaaacggcctaacatcaagtaagagcaccttttcatctggtaaggtttcaataatcttgcccagttctacagcagtaattagcgaacaaccctgcggcttattatatcgctgttccttgggcttgaagcttggcaggacaggagcggtcgccctcttcaataacaccggcgaagatgtcttatagctcaccaaagggctactggctttggggctgtggtatatgttgctgttcatgctgttatgataactgttcataggagcatgcctcgaatatacatgcgaactcgatccgaccaaagtgctagtctcggaaagcactgaagtgcggtcggtgggtagaatgcttgggcagtctacactgtccttcatgttctatatgataagtagatctgtgttgctgatggagaagggagatacaatacggattttctatgaactttgcagtgataagagcacctacgctattataacaccgatgttagaataatatgcaagtttgtggtctgtgtatacagttctttgtttgtgcttgaagtgatgatgttacatgtcaaagaaagaaaaccgctaaggtcaatgaaaatatagtgttacatccgccggtgcaaatggcgaggagaagattggactcttgcgcatcgaacactacctatctgcatccatccatgccaggtgcgcaaactgttgggtctggctaacaccacattctcgctgcgctgtgttctccgatgacgttttgccgcaaaatatttttttcatgaaggtcttttcttttcgttcagcgtcagcgggcccaaatctcaaagtcgccgccattctgtttaatgtttaaagtttccgctcactacaccaagatggcagcaggagatgccagaaaaagcgtggggtctggtctggttagatattagaagtacatacacatcggtgggtgtgtagcagtggcgacacataaaatggccataatgggggtgattttacgtatagcatacatagacatctgtcgttgaggttcgctaccagtgaacggatttaacgagcaagcagcgaaagtagccgaaaacctcttattgttaatagtcatttagcagccgttctgctgctgttttcctgtggggtgaggtgggctgtgattcggtaaactcgcttgcggtctaacaaaaacagagaaaaacttggtacaaaaagatttcattggacgcaaccggaatcgaaccgatgacctcttccttgcaagggaagcgcgctaccaactgcgccatgtgcccagaatttctgtatgtgttggatctcaacacggggtacctccgtataagcaattttaacccgtagatgattttagagtttcgttcctacacgcatgaaaaaggtaagattgagtatgcctaagatgaaccaatcaaagttataaatacctgaagaaatgagtttagatctgttggatggtgaaacataaaaaacagaatgaggaataatcgtaatatttttatgtagaaatatcaagtccattgtaaggattctaatatcctcgaggagaacttctagtatattctgtatacataatattattgcctttatcaacaacggaatcccaacaatcatctcaaagttcaccaaaagtctcaagatccgacttaaatcttatataatatgtagaattgcctgcaaaagtgtacgattttacaataaaaaacgtcgaattagcttttcgcatacgtctcaaccaagaggagagcggtaaaaattatgggaaactcaatcgttaaccttgcgcctgatcaaaacaatcattaatagccatattatttttatcaacttctggacagtcaatactccagggataataatgggaccaagcatcattggcaactactctcagctcggcacgccaagaatcaccgtggctataggtaacacaaaacgctgtcttgccgtgattgtgcatactggatactgaaacacgaactgcacatgttaaatttccttcagaggctgtaatatcacagctactgtttgttgaccacgtcttgacaaacaaactccaaccctcttgcccatcaaaaaagatattcgtgaactcctggctgccgcaaaacttcttgtcaccgctcccgtgaacggcccatgctacccattgcgctatgtagctgttcaaattagtcgtaagagttgtggaagagacggccctattgtacaacctagaccaagttcttacctccactccgtaaaacttggctctacagagggtagattcacctgtttcctggttgcggttgtattgcaggtctgctggtgtttccacagaaccatcgacggctacattaatggcattactgatacttattgccgtgacgtcattttgaagttgctcgacgagactatgctgagtgaagttggctgcttgggtagttatattactgataatgttagggtattcagtagcatcacgcttgttgaaggactcaggtacagtaccatttgcagttaatcctatcgtctggtaaaattcaaccatagaaactggagcgattgccaaatcatcgtccatttgccagaatcctgatggcaagccctggctttcaccgcccgtcaggtagatctcagcacgtgtgcatgcgcataacaataagatcgcataaaaaaatgagacggtatagtatcctgaggtcatttttctcccttggattgattgcttgcttttgtatctttcttataatagttctttcagaagagcccaatatgcggttattatataagttaagttacggctatgtgaagattttgaataatgtaaaactgttagaaagcattgcctcttgtataagatgtggtcgcattacttcagttaatgacttgaaccagtttgtttttcaatccacggctgtattcttcactaataaaaccgattagcgggagtcagggaaatagaaagaatatttgcaaatggagcaccattttagaattaattttttttcagtgctcacaggttgatgataatgacaaaatattttgttctttagaattatttacatattgtttagagatgaacgattattcacacttattactatattggtttaaaatggttaacagtttgctcgagatatcaacacaatctagtcttacataaaactttcttttttgtccctggaaatctggcgcaaaccctttttcataggattgacttaaaatagttgaagagcgatttctcttgcaaaaaaaggtgctaacccttcttactttggtttattttcgtgttggaacaagtagtacaaaaatatacaggcgagttgatataataacattatgtgcgttctcatcgtatacttaggcacatctcttatacgcttatatataattgcaacagtaacagaataatgaaactgttaaaagcaatatgtagacaatgacgcaattgagttacagatccaatatatacgtggaaaatatgagttgttacactgaacatgttatatttacctgacataccactatattgtactgatgatacttaagacgtgccaattgcgcgtgttatatgaacctctccttcatagtataggaagatgtactttcattcttaattaacaccacctttgaataatttatcatcagtaactttcaattaacaaaaaaaataggaaaaaaatttgaaaaaacctcaaaactatgtacatattgaaaggagtaaataatcaatttttacttaaaacttgtcatagctggtttcaagtatcagctcggccaagtcctccatgatgcgctcttcactggtacttgtattttcgctatcacccttccttcttgagttgccttcaatgtccgctaaatcttccagtaatatttgcttcagcctcaaaaggtgccttctggcaagaaacttctttctttccgtgccttttaaactggctatttcctcactgtccagtgacggaagcttgattctctcggttaaaaccttgactaaacgaattccctccaacgtaacaaaccgcttgtcttctatgctcgctttaaattccttcccgaactcaccattcaataaagatttcaagtattcatctagtatacttttcagttccactgtagacactttatcattcatgttcagatttttaacgataggaaacaggaacttccatgaattaaacctgtaaactttgccgttcaactttgatgagtatgtggcctctacgctatctataaacccccgaatcttgtgcaaagtagcttcagcatttgatgcatctttgtttataacggccttgagactttgtctttggaatgcgttgtacaccaaaattaacgtcctcctggttattgagatttgtgccgacgaggctacccgttcataaatgtccagacactcgtcgccgcaagtgatgggcctcgttgttatgacagtttccatgtatttgtggtatatgctctgatctaacatttggttgttctgtgcctctaatgtcttaaatatttccatagcaagatcatattccttgtttttcaaacagtaattcataaacaatcccacaacatgtttgttgagaggaaatggcttattgatgttccaatgacttagtggaactaacgtaggaaaatcgctttgtgtcaaatacttcttgaaaatggtcttatcaaattgaaaatattcacagagggcccatagtcccattccttgcttctcaatctttggtgacttctggctacatattacttcacagtactcaaataacaatttagaatcgacacaatagtctggtattttattcatcaaatcattgagtaccaccataaaacgtttctcatcggcaatcctggtacaagatcttatcattaaggtatatgtaatactatcctttttcaaacctgggcactttttattaagaagtttgaacactagtgtttcatcggtacaatttatcagtgccgccaaagcggtattatattctatttccgtgagctcatttttgtcacacaaactatctatagtcttcaaaacaagttctccgtatttttttgagaccaaattttcttgttttgagagcccattaaagaggattgtgatggaatgttgatcaatagggactccccatttttttcgccaattgaagatatctacagcactttgttgggactgcacaacttcgatataatatttcataatcaaattcatcccaacgacgcctttctttttagctagcctagccaaaaagacagctttttccagttgtcctcttttcaaaaatttttgaacatcattggcgattaatttggaatcacgtaactgttctccattgacgcctagtatggtataaaagagtctcttatctttggttaaggataggaacttcaagtcgctttggctagttggccccagttttgtatctgctaatgcctcattatttattttatgaaattttcgaagaatatgaaaagcttgatccttggggtatgctgtcttttgcagttttttcaattgtcttcttttcttagaatttatcctttccaattgtttggatgttttatttaatatgaaaccgtgacgttctagctcatgtagtctttcttttacttgagttttctgtagatttgtcagtgaatgaaaagatcttctcagcagatgctctgtgagattaattgcagtgtttattcggggtagcattctagtaaatatacaagtgtctacacctattcttgaagactgcgatgactttgaggatgattgattcagatccttggttctcagctgtccttttgtaatttttagacccatctttattttgccgtaactaaaaataaaaactaaagagcagtgcccaagaagaagaggaaaaaaacaaaaagaaagctgaagaaaagtatctcaagatattttcagtaaatttttttttttttgaattttccgtttaatattaaaagaccttaaatcgataagttatgtatctgtatatacagggtgtactcaatttagcaataacattacagtggtgccacttggtcctcctcgaattttgtagataagccattttgcatgacattttctaaatcgtcaatttctttcactgcttcaacagttaaattagtgtaagtatcttcaccaatggctatgtcatcttcaattcttattccgacgtttctaaagtaagatggaaatgattcctcgttaggaatatataaacccggttcaatagtaataacttgtccaacctttaatggttcgtacctggaaactttaggcacatcgtgaacatctagacctaaattgtgtccaatatagtgcggatacaatttttcaacattccaaccggagactttatctatgcccaagtttttcaattcctgtttcatgagtgtgatactcttttcatggatgtcgtggagggaatagttattgctagctttacataacttaatgcaatcacgctgaacatttaatacagcttcgtagagatctctttgtgcatcagtgaatttcccactattgggccacgttctcgaaatatcagcacaataaccacccaaggagccagcagcgtctacaagaaccatttcgtcgtcaaacatcacatcatcgtttcttgtgtaatggatacacaaagaattcgaaccagtagcgaccacggggatatatgcgtccttatcgcaaccaccggatataaacttgtaatgaagaaaggaatctaaagttctctcattcctaaatcttttagcaaaggcttgattgaacgatcttcctgatatttggccagctctcctcataattctcaactcttgaggggacttgatcttacggaactctgcaattcttttactgatgggtttgatggtcttattcgcaatggaattcaatgatcgattgctattcccactgccatctaacaggctcttgatgtgtttaaaattggacgaactgggattagaagttgatagcatatcaaaatagatgaaatcattcctgttaattattttgggcaaatatttagacaaatcgttaatggaagcagattcatcggcattgaaaatttcttgaacaccataaaccccagacctaaatccttcccacttttcagcaaacgcatcctttggcggaaccagcatgtggaaaattgtatcacttaaactatccgttggcttttctaaaatcatgaccgaattaggttcattccaaccactaagataaaacaggtcattttcctgttggaacggataaaatactgctccagatgcaaattggatatcgttaccagctaaaatcacacaacttttgggaggcaatgtttccgccaacctaattcttctttcatagtattccaaggctgaaatgcctggtgtcaactcgcccgactttataaggaacggccttgtctcatgcagtggttggcctgcctcaatggggattctgactctattagtaaaagtattacttttatgctgttccaatggcgataccaacttcgagaagtatctttggcaagattgcatagaaaaccgtactgggtttatcctatgtaacatatcaacagaaaatgaccacttttcctattagctttttctattatattctttagaattggtggagtttcttgcgcaaacgatccacttttgcagtgcagtaagtgatccctataccaggtgagttgatatatatttactgtatcttgtactattttatgaacaagaaaggctattactcacaacagttttggtttcagtcaaagtttatgtgtgagtgtgagtgtgaatgtgtgcgtgttgcataattgcatttggcctttccgagaaataagtcattctttatttttctctctttacggtttaatggtgcggctttcgtatctgcgtctcatccttcccccttgccgcttgtcagaactctctagcttggcgattctctatcaacctgttattccaattcttatatctaccattaccttccagcattttttcaaatgtgttcacacgccctgtaacgtttatatataaatattttaatatttaacttagcttatgcatatatagttaaaagggataataacaataagaataaaaaacacaaactgctgagataagaaaaggaagcgaatagttaataatgcctgattcatcacattcaataagctcaaaagatgttgcatctgccatctctctctatgatcagtccatttacactaataacaggtctactaacctggacttagatcagagatcaatgagcccttccaatattgcctctggtgaagataggataacgagaacgaactcaggttgctccatcacatcaggtgcctccatgattgccacgaaggatggtattcaggggattaatgtcaaaagagatgggattccgaaatattcacttaatttattgaattccatggttcgaaaacaatatgatcacaataatggaacaaagtctcctaccccgaagactagcaatatggtagaccctaagaacaaaaagaagaacaaaaaaaagaagaatgacaaggatgacaaatacaaggtatcgcatgatcaaaccgaaaagttttacaaactcaacaccacttccaactccaatctcacctctgattctactacttcgttatcggaccagttttatttccagaaaagtaacgctgattctgctccattagacaatgcaaattacccactctccgaccattccccctccctaaactctatggataatactacaaagcatagcagcaatgtgcacacttgaatcacgtgaaccacagtaacctaattgctcaaattttgagagttaaaggaaagaataaaatatataaatgatacgtttatacccgctaaaaaaaaaaaatataaaacaaaaaaaggatctcataagacgatttgttgggatatgtccacatctttcggctatatactacatttagctgtttcccgtttctttgtattattcccttcttatgtataacttttactagtaataattataataaatattcgttttgaaacatggtaatttcaaatgttcaatgtattttcgggccgattgctgaccagcgacactttaagccgaactgtatttagtagactcccttttctcatcagcgaagaagaagtagcaaaagctgtttagcaagcaagacagcaatacgaagaccaagcatgattaggtacactgttgctggccattccagaaggtgtgtagtaggagcttcgaaaagagtgggtgcaattaaatgtatcaccgtcgccgccaccaagagatttatctccaataagccaaacgaagtttttaccaagctaacgaatgacaatgatccaaagagagatgcctttttcaaatatacgtggggctcatggcttaaaaatgataagcaagaaaaggaaaaaagattcacgaagttttcgattgaaggtttaaatcgcattctcaatgacatctacattcaatctaatgaaatggctaaggcccccgacggtaagatcttaccaccagtgtttaacaagaacttgaccgtttcattggtcaataacgttgtaccaaagaatataggtaaaatcaacccaaatgaaaaagttcaagtaaccacattatctagtattcacgaaggtaaacatcacagaatatacaaggtcgacacgaatttgaacaaggcatttatcttgaggattccttatccgctggaaaatgaaaacactctatcctacagaataagaagtgaagtagcaaccatggattttgctgacttgaagttgggcatcaaagttcccaagattttttgttatggtgtcaattctttgaaccctgtaaggcagccttttgtcttacaagaatttatcgaaggagaactcttgatgaaagattgggatccattgattgaagacggttcctccaatcaaaaaaaatatgacaatgttattaaacaagtttctgattttcagtcgaagttagtgtcattgaaattaaatgcatttggatccatatattttaacaatgacttaaaagacggaaatgagaaggagtttgttaaggaagacatatacgatggggaaactaatccggatctacaaaacagatggaaaattgggccatccgtggaaagatgtctctggagacataaatctcacttggattttcataaacaaatgaaaccttttttgggaccatggccaaagaagtctccaatggatataattaaaaatactggcctattggaagctgaaaatgctaaaactagaatagccatgaaagaggcaggaagttcagctgaattgatgtatcctcgaactttgaaggagcaaataactacctatgaaaatttagctaagattgccccggatttattcaacgtcaaaacaaaggccattccaaatatgcaggaactattgtcaccacgtttgtttcatcctgatctagaccccatgaatattattgttaacaaagaagcacaagaagcctatctattagattttgaaggagcatgcacaaaacctttcattttacagaattcgccacaattcatcgcctatgatgggcccaagatttatgacttaaaggaggacataaccgattttgacaaattatctgaggcggaaaaggtgcaatatcagttcatgtacaagcgcacccgtaatcaacatcaatgggagaaaaaattaaatgacaataatcctaaattaattactgcagttgccccacctgttaagctactgagaagcccatatattgcagctgtcgaaagaaaaacggaagaagagtatttacttattgatgaatcactattgcaattgaaggaagtttgggacatctttgcccagaatgagttagtgaatcagaaaaagtttcctctaaactatagtaaagaagatattgaaagacatgttgaggatttgcaaaaattacacgaaaagctaatctctacaccatttgctgccactcaagggtggattcctcaagatatgtttgatcaactattaaattccggcagtattgttaagcaagagaacggagactacaccgtgaagcaacctgaagctaccaaataatctatactaaaaatgaaatatttttttgttttctttacctcattcaactgtatagaacgttataacaaaataatcaagttaaaacccttttttgtacacaatggaatctcttccatttactaatcaacttaacaatgctggattggatatattgataacgttttaaaaagcgttgcgtgatgtttgggtgcaattggcggaaaagcggaactttcaaatttacgataggtggagatacatctccacctttctccccattatctttgaattttcctcaaatatataaagagaacaacaaatccatagaaatgccattgtttaatcctgattatctacattgttttagttttttactcacaatcgagtaatgcctttgtttggccaagctatgtgcaaatatcacaaattaaaaatttggttaagcagttaggctggacctaatattttagaaaaacctaattttttttgtggacccattttcgatatttactcacaaatggaattcaaggggaacaacttcggtctcagcactttaattattcttctcgttcccacctaatttcgcaatttattgtccttgacttctaccacgagaaaaaaattaagaaaatgcaacgctgcccgtgcagggttttctgagcgggatgaaaaaatcagacaaatatccaagttatgagtaattactttgttggaaggagggagcagaggataaggaaattcttaaaactgttatgtatataaaggaagaaccatttctagttatttcactttttgatacttgtcaactatcttagtaaaaatacagaactctataaagaaccacagaaaaatcgacagcaatgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactattagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtatcggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaatatgcaatcgattctcatactgtcaactttttgaacatgattaaaagtttcctataaaatattaaaaagaaccaaaaaaaaaatggatagaagaatgcttgaggcaataataatgattatctattttatatatacatacataatcatttaagttttttttttaaagatatttcgatttagccgaatctgctcaatgcctcttcgatgacatccttgtggtcttctgaaattaggccttgtttgatttggtggtttcttttacgaatatttttctccttatccagttgtttctgtactcttaattttctttcatcaataacgttttgagtctttttacgcaaaaaggaacgcaaacccgaattcttacctttcacatcaggttttacatctggaatgtcgctgttggttttggctttattattagcatccattgtagtttgcgccaaatccttagcgtttaaccttatggtagaagaccttttatccactgaaccgatggaattcggatctaaagtaattgtatctgctggcagtttgttcaatagggttctgacttcctgttcctgtctttgttttttggtttcgaatgggtttaattctaaggcatcgtaattggcttcacctgcaccaggtacaatcaaattcgtaatacccgtttgatggcctacacctagtaaatcttcaaatggtacgaatcccaaattttctactttgtttccggcaaacaaatgtgacatgtaaggggtgtttctatgtgggttccctcccatggacccgaagcacggtttactgtctccacttaattttaaagcgtccttccacaacgtaacgtgagggcccctagataatgccaatagaccagtatctgaaatggaaacgtttgttcctggcgtcggtaagctttccacagaatgtagttgcttgaagtttctgatatcccaaattttcatcgacctatcagcccctgtggttgccatgtaatacccgcttctatcgatagcaatgctgttcactggtcctctggcagaaagtaattttactaatggttcaggcatggatggtgaccagagggatactgtaccgtttgaatgacctagatgcatcacagcattccatgggttttgtgccattgccatagttggcccagctttggtcctcaattccgagaccaactggccagtggaaacatcgtggtacttcaaccaacctgtctcaccggcagttacgagcaggtaatgatatggtagaaaatctaaatgtcttgcctcaatatgttgtttcaaacgatgtaattctgtaccttcgtgatcataaataaatgtatattttttttgcgctacagcaaagtattgttcgttttgcaaatatgtcgctgagtgacaggtttcattcaaaaacagctcagcacgaagttgtccctttctccagtccatagatgctacgtgacctttgcggccagtaatcaaaagatgcgtaccgttttttgcatattttatatgataagggccgaattccttcaaagataaatccaaagctttgtttgcagtactgacatccacactcgatttgatttccgattgttgcactttgaaagtcttttctagctcattctcaggttccaaataaccattggactcgggtaaaaggtaatctgttgccgcagcagaagataccgcctttttatattgctcgtctatttttttcaagcctgctcttagttttttatcctttgtttgagtatgattatttttagcattattagtatatgtggaacgttcaaatttattctggttttctctttcttttatctggcgtctgtgaccgttcttcttgtgacccattgtgtcgttggaatctggttcagtttcttaaagctaggatactgagtttttaatgctatatatggatttttttttactattgaactccaattcagttctatacatcgatttttcacgaactcatcgcttagaaaattttcttaccgtttttctttttttttcaattacctgaaaagaaagccgggaataatgtcgggttatgagaacaatgtattatattactgaactatctagaatttataagtacgtcaataagcctaagacaattagcacaaacgaaatgtcagtgattagcatggacaatagatcccagtattgcaaaagggtaattagcttccccttcaggttggcgacgggaattactccctcgggcaccagtgaaactaacttgacaagtttattggtatcttgtaaatttttaatcttgctcttgtgttccacattcttcaatagctggtagtagatggatatggaaaggaactcaaacgtggcaaaaattctagtgaaattcgatgggttccgcaaaggtgcaaaccaagctgattgagtaaatgcataggccggccacacagaggaatttggtcttgtgattaggtatagatagggtagtaggaaaaagacccacttcacaagaatggtccaggctttcagtctgttcagcaagtaatcatggtagtccaaagcagcttgattgatcggggctgcaggagccgcttgaccaaacgatggtgtaccctctgcactgggcatgccagtgttcatagaacttagtagtgagagtagatcgggcgtagaggagtcctgaggggtacttttacccgtaccttggccttgcatggcagcgagctgtttcaataggtccaattggggcgctacgttgctatcttctttgatatctggagtagccgaatgcacactcgcaggtggtgtggtctttgcagcgctaggagcgtctaaaggtgattctgcgttcaaatgactgcttgcctgcccggtgattttattaagcctggagctggcacctccattgctaaacttcttctgtctcctttcccttagtaacctgcgcttttccgcctctgttaattcagacatatttcctagagctacgttgctgatgctacaaacatggaagagctcatttgtacatatccatatcattcaaatcttttcatgttcctattcttgttcttttgtcccagcaaacgcgcacggcggggtcaccccaaatttttatttaccttatgttataagagcaaccatctcatccccaaacttctccctccctcccttttcacaaagagagtaatgctcaacccaagtagccatccgccttccccggattttcccacaggatcttctgcaagtcctagggtcaaactgagaccatccacgttgtgggcaccaccactcacagtatcctctgactttgcggcttccagtagttctactgcccctgtcaccgtcacagataaacctgtcacacccgctgtatcaaagcggtatcaaccttaactcagattttcaagaaacagaatagcacattctctaacatcaagttatcataccaatatataacacaaattatgcataaatagataagtaatatgtccctctgcccctgcctttccctttccagatgctggcatcgaaagtaaggcatgtatttgtatgtaagttttttaattaatagtcttcttctttcttatcagtcgtgctcttctttccaaattaataggtttgaatcttatcggaatcacctggaattcgttctcattacatggccgcccaccatgcacctttacatttcgtatttctttcctctctgcgctatatctttgggaaagatttgcaatcaaggcaaacacccgcttgtcccctttcaattcttgtgttatttcaaaaaccatcctttcataatatatttgtatttctttcgccctggactctaccagttcatatttagaaccttccacatatcgtccaattctgcagcccacatctttttccaccacgatacgggaaacagaatgggtccttggattctcgctaaacagtctctctattcccctgttcaaaaccctcaagatatttgtttcccgcaacagctgcaattgcaattgatcaatcctatgcgaaaatgccgagtttatgttattcaagacgcattttaaaaaattcactagcggctccttgaaattcattatgtctgatgaatatgaaaaccttttcctgactaccaagactctttaactcttctctctttattgcatattatctctgctattttgtgacgttcaattttaattgacgcgaaaaagaaaaaataagaagggcaaaaagaaaaagcgcagcgggtagcaaatttggaatcgcataaaaagaaaaaaaaaatatcaaagaaaaagagtcatctcaaacatatgtctgcagatacttcattatcagctttgaaaacttttgttgttgctgctttgagttctttcttgtgtgagtgctacaagccacatttaaactaagtcaattacacaaagttagtgatgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaaaaccgacaatttactttataaatttacgcaacaacttgttaggtaaaatgaacgtcgtcataatttaaatactagacagcgcgtgtatgttactcatatttatactcatatcatgtgaacctataaaccaattcaatacaagatttacagttctcttgttttcttcttccagttttccccttttatttcctgtagaataaacttaaacagtgatcattaatttataattttctgctttgtaaatacggcggtaatggatgaacaaatgaaaacaaggtttgaaacatagacgtaaggattttatactcctttcaaaaccactaattgaccaacgcctttttttgaagattgacttcttccacatagccatgttgaaatatcgtacattgtctcgatcatgtcatatttttcacccaaaatctctttcaaacaataccctgaaatctgaaactactcaggaactacttcaaactgtgggattcgtaagacgctcgcaggttgggttgttccaatggctgccacttggactcagatcacttaataaagtatcaaatgctatacggaaccgaatggatagcgatggtggagccatagaagtttcattaagtgctatctcgtcaaaagcattatggcaagcgacggatcgctggaacaacagtgaattatttaaattgaaggattctaaagggaagcagtactgcttgacagcaacatgtgaggaggacattacagatttaatgaaaaattacattgctagttataaagatatgcctatcacaatataccaaatgacaagaaaatatagggacgaaatcagacccaggggtggtatcttacgtggacgagaatttttaatgaaggatgcgtattcgtttgctagtaatgaagaggatgcgtttgccagttttcaaaagctagatgatacttacaataagatattcaaagatctgaaaatcccctttgttagtgcgtgggcagatagcggtgacattggcggtgagtttagcaaagaatttcacctgattcatgaatccggtgaggataccttgatgagttgcaaacattgcggcgatatatcaactttggatatgtcccagtcatatcctgaaaaagatggtcaatattcaggtgatgtcgattgtaagtatgctttgactaaggatcactcaacattgatatgtttctactatccaaaggatagacaattgaattggaatttagcattaaatgctatggataaagacatcgatttgacgttgaggaacaaaccaaatgatcacgtcttacaagtctacgaaaaagataacgaagatattatgttcagtaaaatattaagagttatggactgtagattgaattcaaaatccaactttcctgattttccactaaagaaatacctgaaaaataattttggtcaaatcagtgacgtttctatagtggatgcacaggaaaacgaaatctgtggcaaatgtgaggaaggaaggttagaacctctcaaaagtattgaggtaggccacatatttttgctgggtaataaatactcgaagccgttaaatgtcaagtttgtcgacaaagaaaacaaaaacgagacatttgtccatatgggttgctacggcattggagtaagcaggctagttggagcaattgctgaactagggcgtgattccaatggatttagatggcccgctataatggctccatacaaagtatcgatttgtactggaccaaataatcctgaaaactcacagaggttacaggatgttaaatcagagctgctgaatgatcctaccatgcaaaatttacagaatgacatccttgaccagtttaatgaaaaactgggtataggtgctagaataaaattatcgcatgccatgggtataccattatgtgttatcgtgggctcaaaaagttggcccaatgtggaaattgaagttcgtggcataagatggggagaaaaggacctgtggagaaagcagtttgaaaaaagatgtagcgaactgcaatggaagtgtaccaaaaatgaacatggaattgagaaacatactgttccaatccagcatttagcggaagtcattggcgtattgctaaaggatatgtagccacaaagcaagccatttccgtcttgtatacatgtatataacaccaaaataaaaagaaccatgaattgaaaaacatacctcgttctgtggaagtaagtatttagtgtattaaagatatatacgtgcttctatagaaacttgaatcaaaaagtaccgtggacgttatccgatggcaggaatttattcaaaacaaggcaattctcgcgttcgtttgctcgtagtcttgttttgtcaaatagggtggataaaagctgaatcattactgaagaaaattcttaaaataacttaccggcaactttagaaataacatgtaatgcaacaacagaaaagatgaaaccgaccgctagaaacaacacaactaagggatctactcttagtcccgtagcctcatcagaataaatcttcaaaatcgaattattgctgttcgtgtttttctttggagcggatgccgcaactttttgtgaacttccctgttttctcttttgcaaagtacgttgaccacctggaggagttgggcttgacattatggagtatggtaggaggtagagtgtggtgttttgaagtggtggttgaaatcttttcccttcatcaaaaggctaccgtgtattaaaataaaaacacgattttttatgatgctttccttttccaatgtgaaaagttcagggtaacgttgtttgcgttccacgaaaaaaaatagttgaagcggaaatgaagaatggatgaatacgtcatataaaccaaagaaacttttatacttttaaatatgctaaactatagaaatttaatgaacaagcccgctaaattcacatttttctttttgttgttgatatttttttatttttatttttttttcattttaagttttcccctcacagcatatccttgaagatagtgtttatgcttggcagcggactgttgtttgtggtagtagttgtagaactagagtggtttatcatgttattggtggtttcggtagtgatggatgtagttgtggaagaaggcttcggtctcggagtaatggcttcagaacgaaagttgtttaacaaagcaatatcttgcgggtttttggaattaggggtgcgattcatggttgcagccgaggagctggtatcggaggttatggtgcacctagaaccagcatcagaagtattcgatgaatcatctgcgggatccggtgaaaagatcggatccggtgaaacgtctttggaggatatgttggaactgctggatgaaaagacagtcttgttactggattgtttagcacggtgcagcgggtctacattatcttcgtcatcatcgttactaccatcacccataacgtcctctttgtcgctacctttgtcatcatcagtggtagaaccacttttgaacattcttggacaagttttcttggacagagttttttgaggtgaatgtgtaggagacaacatatccgcatcacttgacaaggcgtttaatctccattgaatttccacctcagttctctgcggcaaaagaatggatagttccataacggataggtttctctttttgttttccattagcaaagcgtcttcatcttttgaccatagattagtcggattacacgatgacttcatagaatggccagaaaacgaacctcgtttagacttatgcaaagtggatgacgatgacaccgatgaagaatgtgggagatccataaaggtataagagttggggaaaatgggcccgttgttggaggtaggacctccactgttacttaagttgtttaatctttgctgaaattccttcttgatgacagattcccttcttgagttggtattagaagtagaagcagtgttactgccgctattgttgacattgaatatgtttgacacggaatttggtgcaagaatcattgaagaccgtcttgaagtgttgttacttgaaacattaaacgatgatcttctggaccaattcgcaagcgagccccttcttgactttgagcttagtaagacatgcgaagagtttggagaagacggagtagtggttattgctacctgttgtggataggcaaacgaacttcttctggatctaacgaatactttaggaatgaatccatacttctcctcatcattagaccgaacgatggggtcttggttcaaagaattggtgaaggagtgagagtttgaccttggctttagagtcttatgatggggatggtggtgtaggtgttgatgaggatgatgagggagtgcggccggcagcgtgggaggagcgaacggcatggaagaagcagcgtttgagacaatcgtagtgggagtcacattggacggagattgagaaaatgacatcgatgcgtgaaacgaaggcaacgaggtctttctggagggaatcgggatggatgacgttgtagtgaactcagcagtatcttccgttaatacgttttcttctaccttcttgctgggcttttgctgagcgttggcagtctcatcgccgtgggtgatcttgagtgggcccgtataggtgttgatgtcgatcaaagcagtcttgttcgacttcaagttaccagacttcaaccttctccatctgaactgacacgcgttaggagtcctgtttgggaagtattgcgaaatatccttccagcccattttcttgacctcctttaaatgacgtagcagcagatcatcttgagggtcccaagaggaagggttcttgctcgaattcttggaagacgcagatgccgatgccgaagtcgacgatgaagaggaagctggcagagagggcgaagattcctgggcttcgttcttggacatagctgttgacgacgagtgtggctgacgagtgagtgagtgtagctgaggatgggtgtccatgctgctcaaatgaatggaagctgagttcaaactggttgaaatggacatcacggagcagagaagggagggaagactggaacgtgcacggaagctattcgatgaggtcggatgaactgactgtgaaaaggaggaaacacggataaatatactacaaaagagagaaaaaatacaacaagataccaaacaggacgaaagagagaagaaatagagaagatgcaaagaaaagaacacttttcaaaacctgtccctgtttttgttgtactcggtttttttcctttttaaactgtgtgcactttctgattccgtcttgtcgaggctgtcggagaaaagagtagcacacacgacgataacaatagatacggtagattggatggggcacagatgtgcaaggcaatgcgcgaatcctgtctacgatgtctgtaccgtccatcctttctcctttgcatcggaaacatccgcgctgtctaccttaggaggacctcatgggacgggcgctggggactcgtgcccatccgggactgggggtgagatttcacaacggggccgctgctggtctcaccctctggccgggccggtccgtttttgtggcgtcgctgcaggtaaacgcgcagtttctgcgcgtttacccctgaggtgaataccatcttcaagcgtcaaactgcatccggatatcctgctgttggtagcgatggtggtggtagtggtgtatgctcttggttctggtggtgtcttgcgtcttctcttctctttctgttcgttcggttcgtatataggtatgtatatataatgaaggatggaagatccttcattgcaagtgggaacggccggccttgtggtcagtgttactgtcattctcgggatgggaggaagccgggtcatggcccatggtttggagcagttgggccaaggcagactggggaagagtgtaggtgactttgttcccgttgctgtctgtcttcactcctcctgtagcaccaagtagcgcctccaaggatgctagatcaatggggccggaggtcttgctcttggattggctggaagggtcaagattttctgcatctgtgtcagcgtccgtgtcgtctatgtccattggatcgtcgttatcggcggcagtcaccgaggccacagcggcttcgtggtcgcgagtgaatttgtcctgaggtttcttcgtagtgatagcgaacacctgttcgtcgttacatttggaaaaatcgtagtaactaaacacccttcttctcttgtctgcaaaagaacgcactgatgtgcggtgggccttggacttcatacggtcgctccattgagcgacgtcttcaccttctttcagcagcgcgacaaccactatactcatgttgtcgcatccaatacccgtcccctctgtggtgggagcacaacagacatcgatgatccgcgaagaaatttcattcaatgtcttgccttcgcgaaggccgagatgaaccaagtccacacaatcttgggaagtcaaacaatcccagataccatcacaggctaagattacaaactcgtccctatcgtaatctagagaatgctcgagaatgtccggaacacatgtcactatttgctcctcggggcccaatttggggttggatttgaactcaaaatcaccaatggcacgagagagcgccaagttaccgttgaccctatccatttctacgaagccatcagctgccacaatacgtgatttttcgcttgctagagtgggcttgtgatcgtatgataatgcctttgcgttcccgtcggtggcgagtacggttctactgtcaccagcgttaccacatactaacaagttctgggactttgatactaatatggatgtagccgtacatccgctatggtcttctttcatcacaggatcttgtaacagtttcacgtctgtgtttatgaaagtatcaatcaaagcccttggtaaatttccttcatggaacgatttctgctcttgcaggatctccactattttattaccacagtattctgctactttagcgccaccatgaccatcgaatataccgtaaaatgcaatatggtccttatcggactttgtcaaaacattaggctctagaatgtgtgaatcctccattgacatccgccacccttgcattgcacacagtccaaacgcggtcaaggagtcagcaccggagtggctctctttatcaattaccgggtttgatagaatttgtcccatttttctttttctggttctctatattttatacaacaatggaatagtcaaaatcctagggatgttattaatcggaaaactactatctcgaacgaatagttataattaatcaatgaaaaaaaaaaagagaaagtaaaaaatgttacaacaactaatatacactaattgtccttgataacagaacttgttgtagttttattccgtggggaggagggtgaattttttttatttagttttaaagaacaaaacagaagtctatatacttagcactataatatccagtttcaatttgctctgtcagaatccgaattggctggttttctttgttttaccatccccttccatttatcagcatgatatttttttttttagaataatcctttcaatcgttgaagtagtttgtgggaaaaaaaaagttgttaaaggcattaacgtacacagtgatttgctgactcattacgatttttcactcatcgaagtattgttagattttgatatattaacatgactaaagggctatggtccatcgtagcagaaggcaatcatcactttaaaaccgaggccacaatcgataattagcactgatattctgattggaaaaaaggcaaaaaatgaccgcttccatcaaaattcaaccggatattgactctctaaagcaattacagcagcaaaatgacgatagttccataaatatgtatcccgtgtatgcgtatttgccatcattggatctgactcctcacgtggcatatctaaaattggcacaattgaacaaccctgatagaaaggaatcatttctgttggaaagtgctaagacaaataatgaattagatcgttattcattcataggtatctcgccacgcaagaccatcaaaaccggtcctactgaaggcattgaaacagatcctttggaaattttggaaaaggagatgtctacctttaaagtagccgaaaatgttcctggtttaccgaaattaagtggtggtgctattggttatatttcttatgactgtgttcgttatttcgagccaaaaacaagaaggcctttgaaagatgtcctaagacttccagaggcatatttaatgctttgtgataccattattgcctttgataatgtttttcagagatttcaaatcattcataacattaataccaatgaaacttcgttggaggaaggttaccaagctgcagcacaaataatcactgatatcgtatcaaagctaaccgacgattcctcgccaataccatatccagaacaacctcctattaaattgaatcaaacttttgaatcgaatgtgggcaaggaaggttacgaaaatcacgtctccactttgaagaagcatattaagaaaggtgatattattcaaggtgtgccatcgcaaagagtggcaaggccaacttcgttacatcctttcaatatttacagacatttacgtacagtgaacccatctccttacctgttttatattgattgtttggatttccaaatcattggtgcatctccagaattgttgtgcaaatcggattccaaaaatagagtcattacccatccaattgctggtactgtcaaacgtggggctactactgaagaggatgatgctttagcggaccaattacgtggctcgttaaaagaccgtgcagaacatgttatgctggtagatttagcaagaaacgatattaacagaatttgtgacccattaacaacaagtgtcgataaactgttaactattcaaaaattttctcatgtccaacatctggtttctcaagtcagcggtgttctccgcccagaaaagacaagatttgatgcattcagatcgattttccctgcaggtactgtcagtggtgctccaaaggttagagccatggaattgattgccgaactagaaggagaaaggcgtggggtttatgcaggcgccgtaggtcattggtcatacgacggtaaaacaatggacaattgtatcgctttaaggactatggtctataaagatggcattgcttacttgcaagctggcggtggtattgtttacgattcagatgagtacgatgaatatgtcgaaaccatgaataaaatgatggccaatcacagtactattgtgcaagcagaagaattgtgggccgatatcgtaggatcagcttaaaaagggcattctctgtttttttccccttagacgacatttttatagttttcgaataatatgatataatgatgtatagcaggatcctgaaaagtattattctttcgacatatacatttggtccgacttacaaccaaaaaatttttgttcaaaaaatataggaaattttagaaaacgaatgttgaatgcgttataaataatacagaatgtacgtgtatataaaaatataataaaaaaaatgcaagagttatggctttgtaataaaattgatatcaaaaaattacccaaataaacttttaaatgtgaacacaaaaattaaatcaccgatgttgaatcccagaataaaaaacaaaaagttcagaaaatatcattactttgcttcctttttaaaaccttaattcttgtattgttcacggaagtacttggcggcttcgaccatatgagtcaaagacaatctagtttcttcccagcctctagtcttcaaaccacaatctgggttaacccagaacttttcagctgggtagctcttcaagatggttgaaatcttggcgataaattcatcctttgatggaattcttggagaatgaatatcgaataaacctagaccaatgtggtttggatagtttttgaattcagcaatgtagttagcatcgtccttcttagagaattcgatggaaacaacatcagcatccaaagccttgatatggtttggatccaagtcagagtaacagaaatgagagtgtatttgagtcttgttagcaacaccagaagtagcaactctgaaagcttcggcagcccaggtgtagtaagcagatctctcagtaccttctctcaatggtaaaccttctcttaaagctggttcatcaacttggataaccttgataccggcagcttccaaatcattgacttcatctctcaaagccaaagctaattgcatagcttgagttttttggtcgacatcgtctcttgggaaagaccatctcaaacaggtaattggaccagtcaacataccctttactggcttagaagtgatggattgagcgtaaacagattccttgacggacatagcctttggtctggacaagtcaccaacaataattggtggtctgacatatctggaaccgtaagattgaacccaaccgttaacagtgaaagcataaccgttgatttgttcaccgaagtattgaaccatatcgtttctttctggttcaccgtggactaagacatccaaaccaatttcttcttggaatctgatgaccttttcaatttcagaattgatgaatttttcatattcttcagcagagatggtgcccttgttgaatttgtttctgttaattctgatgtccttggtttgagggaaggaaccaatagttgttgttgggaacaatggcaagttgaagactttttgttgttcaggcaatctttgttcaaatggagctgctctagtagacattttttcgtcgatagaggcaactctggccttaacggcagcatcgtggataaacttggatttacctctggattcaacagatttagcgttagcttctagggcagcagcaacgtcttgaccggaaacgttcttggtgatcacaacaacttcatccaatttttgagtggcgaaagagaaaaagcccttgatttcagcgtccaacttggtttcgttgttcaaatcaactggtgtgtgcaatagagaagaagaagtggcaacaacgactctgtcagcacccaacttttcaatagccttgttaacgatagcggaagacttcttgaaatcattcttccaaatgtttctaccatcaacaataccaacggacaaggtttgtttgttaccaatggcggcaacgacttcatcaaattgttctggagctctaacaaagtcaacgtgtaaggcagcaactggcaagcccttgatggcgtctaagttagggacaacggtaccgaagtaagtagccaaagtaatctttggtagattgctttgttcaccgaagtaagtgtaagccttcttaatggcggcttgggcgttggcaggcaagtccaaaactaagacaggttcgtcaatttgaacttcagtggcaccagcagaagccaatttagataggatttcagtgtatagaggcaacaattgttccaatagggacaatggttccaaatctagagaatccttgtcagccttacccaagaataagtaagaaactggacccaacaagacaggtctagtatgaatacctaactccttggcttccaaaaattcgtcaactggcttttggccgttcaacttaaattgagtggtcttggagaaagttggtctaacgtaatggtagttagagtcgaaccatttaaccatttccaaagcagtgacgtcgacagccttttcagtttcagtggcctttctttgtaaacctctacccatagcaaacaaagtgtcgattggagatagatcgtacttagtgtaacggtctggaatgacattgaacaacaaagacaaatccaaaacttggtcgtaaaaggagaagtcattggatgggatgatatcaacaccagcctccttttgcaacttccagttttgagttctcaaatccttaccgaccttgaataattcatcgacagtgattttaccgttccagtaaccttcagtggccttctttaattctctgtttggaccgattcttgggaaccctaagacagcagattgaaccatttttgatatgtactttgaaattatattggtattttgtttcttagagtgttgtcaatgctcttagatgcttgcttttttatgataaaggaagagtttaacaaaaatattgaatacgtaaaagagaaactaatgctagtaaagatggaaatatctatcacttatatagaatttttttttctttcctttttttctttcgcagttgggaaaactagctagcttcccttaaattagtgcatctatcgcatttgttccatattcacattcacagttctcaattgagcagaacgagctatgactaccacagttttgcgaccgggagatagagcgaaagagctgccatgactgcgatgactctagcgaaaaatattggccttttgcacgttcgcgactaaacgagttcgatagtagtcccgtttctggttttttccctttaccggcccacattttttcacctgactccggtcctgacgtacgactctgtttgtaagtcacgtgaaatatttcctgtggcttttactagtaatgtgcacgtgatgtggcgtgatggtcctttacccggagtgcgggaccctggttcatgaaaaattgtgtgaaatcaactgcatttttggaagcgaaaaagatgatgaacctgagttgaatggctgtgggaaaccaatacttgactgattataaaacaagaaaaaaatgcctagtaaagatccagagagcgttatagacaaagaaatacggaagatatcagcaagaaatgatgagcttatcaaacaggatgggactctaaaaagggaatacactacattattgagaaaagtatcgagcgtgataacggtactgaacagtattgatgatgcagatactggttctgctgaaacggaactcccacgcttaatatctcaagcaacagtagagaaagtacccgaattgaagtggtacaatgatcagatatcactgattacagaaaagttggaggacgatgaagatattgaggttcccgaggagctaatggatgcttatactctgtacaaggaaaccccattattatataatgatacgcacacaccataacggttttgtatgctgtggtgtagggaagtgcctgggtctatggaatattgtgactatatacatttatacatgcggcccttttttgctctaacgtgtaaaattagccggccttttgtcccttttgttgtcgtgcctgatgacattttcaagcgctctattgttaataaatagtccgcaaagaaacttcctaacatgtggcttaaaccgatacttcgacatcatattaaatactttgaagaacattttctcgttttcaaaaagccttggaccgtatttattgtttatttctgtaatctccttcactgcgtgatttgaaaggatatgattgcctagctgacttactatatgtagtaccttgctctcgatggagtcatcgtcattgcggtattgtgtaacatagggagaagaaaggccttcgtttgcgaaaagactactattttcacctgaaacagtgatagtttgacttgtgatatcgttgtcgtatttattagtaatgattttttcatttaatggattctctgcggtatctttctctttgagtagtttgtccaaatcaaattcgatgggtaagcatttttctatcaagtcgccatcgcttttattaaaaacaatcatctcatcagaatactcgccaaatgcggaccatttgtgttcgttatacgatagaaatctatcgagcctatttggtagtgcgatcccgataggctcatcttgtacactgacacaacagttccatcccatctcgtctagaatttcgcaaccctcgcgggtcatgctgattaatcccagaacataaaatgctgtaaacctaacgctggttacgctggcattgtaggccacctcgataatatcttccaccaatgagtagttatctagtagacctatccccaattctgtggatccgataaacccaacacaccataatgctgcttttaagtcgagaatttctttggcattttctactgtggccatattgtttccgttgacgtatttttttataacgttcatgaaagtaaccaaatctcctgtttggcttaatagtaatattccgtcttctgttttcgttagactttcataaaaatgcaatggcaggcgactcttttgttgaaatgtgagggattttgcattaattgattcatttttcttcaggaattcctccacaatatgaacatactcaatgttttttttagataaccacgaatccctttcctccttcacaaaattgatttcgttcaacaactggaacccgtatgggcggcttaataactcgaaaagtattggagacctaatgaataccatttggtttaaaaacatcctaaatgaggtgcccagctcttcagagccattgcccgcgacaatacattcatataaagcttggtctgctacggcgactacgctggggctcaggtcgtatagttgccttgttaacatttccattttgaattgctgcagtttcactttattcgcttttaacttaagatcactttctttcgtggataacagttcttttagtttatcgcctatatgctttgtagcctcaatcctaactttctcattggccactacaagggccttgccgataatgacgcggcaatgtgatgaatatttcaaatctaattctggtattgttaataatagaaactcaagccccagtttcgattcaaattgaaacatcttatagattacggtaaaaaaattccacctcgttaggatatgaaccccattctttgactgcgtcaatattccgatgaatttgaagtatccaaatattattttttctcgtagtttattcttgttgaagatgttgcctgatatatttccctccattgctctaaacattaaagacgccagttgcggtataatttttgtatcatccataaggattttcattccttctggagtcgccgttagtgttttgaaaaactggcatccaacttgtacatacttttgagataattttgcgcctttattgacgttggaaaatctcaatctgagtggtctgtaaaacaccaaaagtcttctgatgaatttggttgatttaactaattcttctagttgctttttatttagtaatggtccttcaagtaattcgttaattatgttccaattccatcgcgtaaaatccttcgtttgcaaaactttagagtcataaaccattcttctaaatcggaaatcatctacttcgcggagaagagtattctctttaatatttttggaaaatgattttatattttgagcataatcaatgcccgacatgccaattgtattcctgtttctattcattttataagcgatcttcttgaactggaatgtttcattgacgtaagtgaagttctccttgtaaattggttttgatactgaagtatactttttatcgactaaattcattcttaaattaaaatattcggtaagaagatatctgccttttgctaccaagtgatcatctctatcttcttcgttcaaaagttcaaggaggtggggtacaaattccgagttctccagaattagcacaattaaggctagccgttgattcacagacatacactctttgtagtactgagatgggattggtttgaaagaatgagaatgtctgccccttggcttgtatggtagtggtttgattttcaaaacatcaagaaagatgtcgataagatattgggcgcatataggaatttggaagaatgacaccagctgttttaacggtttgaaattgttgttagaaaaaagcataaagccattgtagctgttcaaagttattgagataagtgtagaagcgttttgcattttttccacattaacgtttgactttgtatttgtatccgaaaagaccgtggttaacacagatacattgaaatcttccagaaaatgttgccttgtcttgtgtgtagccattaattgtaaaatagtatcaagtattactgatgcgagtgaaaaagaagtataatcttgtaaaaatccctcgatcactctcataccacggcattctttaaccatttcaggggcgacaaaacaaagttccaacaaagtttctaatgccatgtgccttaaggagtcttcaggtttttcaacacagcttattatagcctgcataatgccttgagtaacaccgttgttgtattcaatgaatcttcgtaccatttttaaggcttgttccctttctatttgaaaagaattatccttcgcaagggaaataattatgaatgcatccagtcttagctctaacagctcatcaatgaaaatcgagctatttattaggtaacgacataccctataagcagatgctgctataagcttgtttccattgagaagcagattttgaattgatgacatgaatgaagttaaaaccagatcttttcttatctctgaatgttctttcaataaggtgaccaggccatttgctttttgagcaatgaaatcagggttgacgttcttttcttgaaaactttgcatataatcgcttacaagccatgttgccgcttcagttgttgtggatgtgaatatttgattttcgttttcaagatcaccaagatctttttcagtatcaccggttaagtttactttattagatccatctaaatctggaatggaaagcgtagaatgattttcgttattccgtgagttgacggtactattacgatttaagttctgctgactattacgctcagttccagaagtgggagtcgtaagatattcatcatcaagagtaacttgatctgtcaaactatcatggtcgcccaattcttcactatcgttattttggccatcatcattcctgatgctccccacgtcagcctttattgagctggatgttgtgagtgatctttgccttttcttgtcgaactgttgcttgaggtcaaaaatatgcttctcaactctttttattgaattgtcaatttctctaagttgagtattcgctctaatcctcatcgagtgcttttgtaaatgattcgtagagtaagatccagagtatatatcagatattgtagaatcccgaagatgttcgatatcgtcttttttcttgcgcaatcgagctaattcttgatattggttgtttatttctgctttaagatttaaaagtgccttggtcatagtacttctcgttcgtcttgccattaagggactggtcggtgaaggtgcactattttctagcctcttggtggagataaatgaggtcgagagtaccagattttgtttatttcttttggaactttcattcgttatggttgatgggctgctggaggtgatgttcttggcgcttgatatttgggtgctcgagttatcacggctatgtctaggggttaacagtggagtagtattagttactgaccggcgccgacttgagagagggctactctgttttgcactgtgaggtatgctcattgtgaatttcaaaaacttaatagaagcggtacagcacgaagcaacctccctagcgtgtacacctacaaattgaaggtaccttagttatatccgagaacaatagaactgcttgatattccatcttccatttcgccgatggatcaatcaatttttaagagaatgcaaaaaagaaaaagattacaatatgtataattaaaagaagaaagaatgtatacggatatacgatatgtgaccagccggcaacggctcgtagttataccattatttacagtttaaagagattaagccaatgcgtagtgctacttgttgttttcgctcgacaggaggtcttgcaattgcttagttagtttggaagtttcttcgtccatgctcgtgtcggtttctaaggcttgtggaaggctcatgaactctctagtcttaaatacaaactctcttgccgttgaaatgtcaagtgcccaacaaaagccgaatatcaatgtgctgaacgtacctattgaagcggcggatgcatacgttaacgctgacatggcttcattcctttgggaaaaaggtggaagcttgtaattttgttgaaatatgctggggacgtctgctttcagtagacggtgttagtaactatatcctattattagttttggccactgaactaggacaaaatacatacattttcgtacttttatggccctggagataagcctcatggtaatcagggtgaaggcggccgcaccataaaatctggccatttgaagaaccctgcgtttcttaagttccttcttctcttcgatcatagtttcgtttcttgatgaagtaggatagtcgtactaattgctgacaaacccgtcaaagaatcaagttccccatcctaataagtattaaaagcgccaatttttcaagagactcgcggctggtgaataacgctgctccttagaaaaggacagccagcggatagctactcagatcttcgactgactttatgcattttagtatttatatattcattcgatctattctgtttacttaaaaattaaagatgagttggatgtggaaaattcttgacgttccgctgatattttgtgttggggttgtttttgggaccatgagattgccatgaaccgatcaatcttgtctcatcttcaagtatctcttcaccacttcatccttcttgatgatgtatactacagctccccagcctgatagagcgtcacggtcagcagcattcagtagggcctgacttatagtttcgaaaagatcttctggctctagattaggttcgtacagggactcacacataccgaacagttggtcggatgcagtaccgctaacgataaaatccttggcctcgtcgatacagccgattaggtcgaatcccgcaataaagggcttcccggacttggaattaatacctgctaccaccggccccacaaagtatggaccgaatcttctttcataaagtgaacttgacactaattgggtaaacgtttcaggctcaatggccctttcttccttcaacttatataggttcgtcttgtagcggaacatctcgttcagagtagtcacgtcggtagccagaccggtaatccctaagaacacatgcccatagtggaagattttttcaaacttgttcgacacacctagtgactggcttccgagacgcaaatcacaggcaatggccacacagtctttacctgtcatcgcaacgacgataccaccgttaatagaacttggatccgacattttttttttatgctttattcactgttcaatattttcaccacaattcgcaagaaacgcactctacttcgaaactacggttcaaacttacttagcagcttcccgatttaattggcctttctactatgccataaactctttcttcctctcttttcatcgcccctgcatttgcacttttttgccaccggcagtgccatccggtcacatgactacaccacgttaatagcgatctggcttatcattgtcacagagtaaattaaaatggacggtaaatgttggaaatgcaccactaccgttcttcaaccaatctagtttagctatcctgcaacaggtggccttcttgagcattccctgagcattccaaccggttgtatcagtgttttatcaccgtctcaccatatcccacgactaggccacacttcgttaccctatgctacgcgtcatttccgctatttctgtcctggtttgtttacagtacgcgtggtgggaccataaaggggaatagtggggactggagaaaaaattttctcagttacttcttctatcttccgtagtttccatatactagtagttgagtgtagcgacaaagagcagacgtagttatttgttaaaggcctactaatttgttatcgtcatatgtctcaagttcaagaacaacatatatcagagtcacagcttcagtacgggaacggttcgttgatgtccactgtaccagcagacctttcacagtcagtcgttgatggaaacggcaacggtagcagcgaagatattgaggccaccaacggctccggcgatggtggcggattgcaggagcaagcggaagcgcaaggtgaaatggaggatgaagcatacgatgaagctgccttaggttcgtttgtgccaatagaaaaactgcaagtgaacgggattactatggcggatgtgaaaaaactaagggagagtgggcttcacactgctgaagcggtagcatatgctcccagaaaggatttattggaaatcaaaggtatatcggaagctaaggcagataagttgctaaacgaagcggcaaggctagtgcctatgggatttgtcacggctgctgattttcatatgagaagatcggagctgatttgtttgacaacgggttctaagaatttggacactcttttgggtggtggtgtggaaactggttctattactgagcttttcggtgaattcaggacaggtaagtcccagctatgtcacactttggccgtgacatgccaaattccattggatattggtggcggtgaaggtaagtgtttgtatatcgataccgaaggtactttcaggccggtaagattggtatccatagctcagcggttcggattagacccggatgatgctttgaacaacgttgcgtatgcaagagcctataacgccgatcatcagttaagacttctggatgctgctgcccaaatgatgagcgagtctcggttttccttgattgtggtcgattctgttatggctctataccgtacggatttttctggtcgtggtgaactaagcgcaaggcaaatgcatttagccaaatttatgcgtgctttgcaaaggctggccgaccaatttggtgttgcagtcgtcgttactaaccaagtggtcgcccaagttgatggtggtatggcttttaatccagatccaaagaagcctatcggtggtaatattatggcacattcttccaccacgcgattaggtttcaaaaagggtaagggatgtcaaagattatgcaaagttgttgactcaccttgcttaccagaggctgaatgtgtgttcgcgatctatgaagatggtgttggtgaccccagagaagaagacgagtaggtatttggtctcttgtctctatttatttacacaggtttactttcaattctcctctttttcttaggttgcgttccgtacatttttatcttcatttccatccactgtcttagatttttgcatatattttgtcatatacctcgcaaccctactgcggtcttaaccttttttttcagttcttttaaataactttcgtattgtctgtcacccatgaaatatatgtatttttctactcttcttcccgatgactacttcctcctgcagggtccgcgcggctttatccttttaggggagtgaagagaaaaattttctgatatgtcgccatcctcttataaaaccaacgtaaaataccatacacttctttatggcaatgaatttccttgtcttcgtttcgacgtttttaaattgaataaaaaattgtacttggaaaaaagaatagaacaatacttttgctaacagcaagagaagtacggttgacattacgagtatccctttgttaaaatcaggcagtacccataatgtccatgactatttgctcaaatactcctggtgcataccctgaaattggagcttataatgaggttgataaacagttggaatcaagcggattctcctctgattcctctctgatattgaataaaccagaagttcgtcaatactggtcatccgtttcatctcatatttcacgctcaggtgatgtgtttacaaatgataaagaaaaaatttcatcctctattggtgaggatgcgatggatatcgacgcttcgccctcattgattgaaaaatataactcttttcccacaagaaagattcttcctgagcaggacgagtttgagaacgacgttgaggacgatgcttcttcctcactgaaggaaaaatcacaaggttcttgtgaaattgaaattgcttctgaaatttcatccgaaattttaaatggcacatcggcagacggtaattccgagtttcacgacttcgctgagccccctccctctcagaatgaatctgtcgctctgtcttttagtcaatcgaatgatttggactttttgaataatccaagcggatcaggctcttcaaacgatatcaatagaagtacaagttccatttcacttcctagacatgtgtcactagattttaacgtttacaatagtctttgcctcacaaatgaggtgactgcatcagaatcacataatgtggccaaatttcaccttggcaagaaaaacaagaagagcttgctaccaagatggaaaaccattgaaatgtacggggaggtagttaagaaaactcaagacatatattctaattttcagtatgcacaatacattttaagggtagggttggataccgaaaaactacacgaacttgttaaggaactggaggatgaaagcaatagcttctctgtagattctttaaaggaatatttagtgaacgatgccaaagttattttgaagaaactaagtgccgttggataccctgatgcacagtaccttctaggtgacgcctactcctctggagttttcggtaaaataaagaatagaagagcatttcttttattctccgctgcagccaaaagaatgcacatcgaaagtgtttacagaactgccatttgctatgagtgcggcttgggtgtaaccagaaatgcaccgaaggcggttaactttttgacttttgctgcaactaagaaccatcctgcagcaatgtacaaattaggagtatattcgtatcatggtttgatgggtcttccagatgatattctaaccaaaatggatggttatagatggttgcgaagggctacatctatggctagcagctttgtttgtggtgctccttttgaattagccaatatttatatgacgggatataaagatcttatcatttcggatccagattatgctatggcattgtatgagaaggcggcggctttagggcatactgaatcggcaagaatactagaagacgctcgcagaagtggagggtttgtttcgcgaggacatcctccttcggcacagaaatatcataaaacctcccatgaagctgtggcagccaaaaagttgatttaatagataaatacaaacttcgttttccttttattttgttgttttttttttcacaaactgtggaagttcgattaactttagaagtttgtttgatcaaaaatagactgatcctcacacctttcgttactatttgttactttgctgtatatcgaataaataaacctgactaaactccttctgttatttagcgcagatcctatatgctgcatttttagatgtatttgagcactactatcgttaatgccgtggcattggctatggaccagttaagtcacggcctttcttagttctatcatatacgacgttatacttatttactttcccagcgttgaaattaatgtgtctttttcataatatttactttttggtgcggaaatctgtaatattttaaaacaaaatctcatccttttgaaaagaaacgatgaagaaaaaaaataataacatacattgtaccttcactaacacttgtaaaacaaacgcttacattataatggcacaaatgagcaatcagtgtcacttcttcctacataagcataattcaagtatcgggatataaagctattatataccgcttaagataagaggtatacacctcattgatcaaatacgcaacagcgtctcctttcagacctttgtggagtaatttctgcgggtaggattgactatttttcaagatcaatgccccctcacactaagacctgtttgcttagcatcataaatgagtttttccataattaaatttcaaccatagattagaatttcgttgcgggataaaactccagaaccacaacgattatgcagcaaatgtaaccttgaactaaactaagattttgttagagcaggtggtttccgttactcagacaagaacctatagtagaaatataaaagtttaagtaaaactttcttggaataggaatcagccatcatctatcaactagtgtactgatattcataatactggtatacaatcatatacggtgcgggaagatgacataaaaaattgagaaacactcatcaaatttaatggaggccgaaatgcagggactcagatcgtgatagaataataaacgagaacatataaaatggaagaaaaaagaataacaacaatatgtagatttatcgattctgttgataattagaggtaaaaaaatagtattaatgaagaaataattactgatcttcttatactaaataagagaggtatataaaacacacgccgattggtcatattaatcatgaccaatataatagtgattccggtagttactatacattgatgtgacgactcatattcctcatatatgtacctaccataacatgttcaactaataggtgtttaacacagcttcagtattgtctgagcttctcgtttaacattccttctgcaataggcgcaatcacacttaaacgtatacgaggtgtacattaatatacgatgtaagcattagattgttaccatagcaactcatgtcactattaattactctcgttccaacagattctccttttatggattccatatctcgaggagacttctagtatattctgtatacgcaatattatagcgtttacgaacaatgaatcccaacaattattttaaaattcaccaacatctcaatatgtgttttatgaatattttaggtgggtattgtcatactgacgtattccattttgagatgcaacacatacgtgtattgtaatccgatatagtgtaacggctatcacatcacgctttcaccgtggagaccggggttcgactccccgtatcggagtacttttttgacatcatacagtgtatgtatggggttaggagccaccttccaacaaagcatcacgctgtcgtatctcaattgtccttcagcaaaagaaaaagcagttgggctcctgtacgccatatatactttatatgcggtttttaccccggaaatcgcgtttattaatgtcaatgcgcgatttctattatgggttgaaaaagttgcacttctgttcctttccaaacgatatacgccccccccacaagaaaacgtttctcttgcattcaataaggtccatcgaagctgtatttggaacttccgattttattaaacttctaggggcgaactcaacctttcgcttgaacaagcttgaatgtgtcgaaaaccttagctcgatccttaaaaaagtatttgcattatcagtaataaacagaaaattaaaacatttaccaaaggcaacgagtcttccatatgaaaaatgataaaaagatggttatctgtgaataggaaaaagtcacacccggagaagaacactcaaggtaatgacgaaattaatcggaaagcaactagcctgaagaaaacgaaaggttctggagatccctccatagcgaaatcaccaagtgctaagagtagtacatcaagcataccttctaatcttgcgagccatgaaagaagaagcaagtttagtagtcaaacggataaccttgcaggaaataaacattaccatgagcattaccataatatggcaagtacttcagatgaaagagagtacgattcctcgactacatatgaagatcgtgcgttcgatacagagtcctccatactatttactactattacagatttaatgccatatggggatggttccaataaagtgtttggttatgaaaattttgggaatacttgctactgcaactccgttctacaatgcctttataatatccccgaatttaggtgtaatgtgctgcgatatcctgaaagagtagccgcagtaaacagaatacgcaaaagtgatttgaagggttcaaaaataagggtattcactaatgaaagttttgaaacatctactaatagcggaaattctaatacggggtaccaaagcaatgataatgaagatgcacataaccaccaccaccttcagcagagtgatcaagataactcctcttcttctactcaagaaaaacagaataattttgaaagaaaaaggaactcgtttatgggttttggaaaagataaatcgaactataaagattctgcaaagaaagatgataacaatgagatggaacggcctcagcctgttcacacagttgtaatggcctctgatacattaacagagaagcttcacgaaggctgtaaaaaaattattgtgggaagaccgcttttaaagcaaagcgattccttatcaaaagcttcaactacagattgtcaagcaaattcgcattgccagtgtgattcacaaggcagtaggattacatcagtggatgatgatgtccttgttaaccctgagagctgtaacgatgctgtcaacaattctaataataataaagagaatacgtttccaacaagtgaacaaagaaaaaaagccgctttaattagaggccccgttcttaacgtagatcatttactttatccaaccgaggaagctacactttacaatggactaaaagatatatttgagtctattactgaaaacttgtcgctaaccggtatcgtttcacctacagagtttgtcaaaattttaaaaaaagaaaacgtcttgttcaacactatgatgcaacaagatgcccatgaatttttaaactttttattaaatgatttcagtgaatatattcaacgcaataatcccagaatgagattcggaccacaaaagacagacaacagcaacgacaactttataacggatttattcaaaggtacactgacgaataggatcaaatgtttaacttgtgacaatatcacctcaagggacgaaccatttttagactttccaatagaagtacagggtgatgaagagactgatatccagaagatgttaaaaagctatcatcagcgtgagatgttgaacggggttaacaaattttattgtaacaaatgttatggtttacaagaagcagaacgtatggtcggactgaagcaactgccccatattctgtcattgcacctaaaaagattcaagtattcagaggagcaaaagtcaaacatcaaactttttaacaaaatactctatccactaactttggatgtttcttccacttttaatacatcagtatataaaaaatatgaactaagcggcgtcgtcatccatatggggagcggtccacagcatggtcattacgtatgcatttgcaggaacgaaaagtttgggtggcttttgtatgatgacgaaacggtggaatccataaaagaagaaactgtgttacaattcacaggtcatccaggtgatcaaactacagcctacgttttattctataaagaaacacaggctgataagaccgaaaatcaaaatgaaaatatagacacttctagtcaagatcaaatgcagactgacaataacattgaacagttaataaaatgcgatgattggttaagggatcgtaaattgagggcagctgcaaatattgaacgcaaaaagaccttggggaatatacctgaagttaagactgcagaaaccaagacgccattaaatgataaaaaacgcaataagcaaaaaagaaaatcgagaatattgagcttcatcaaataaatcgggattgtttcgatacatcatatagttgagacccatctgttctaaaagtatcaatattagtgtaccattttttcttccttttttaaataatttccacgtttctttctattgttcctgatctttcgaatttagttgtatttcacttcacctactgtaataactttttttttttagagcacaataaaatttcacatattttccaaaagcaagggcggtaaatcagaaaagattaagctttaatgaaaatctcatagagaccagatgaagaatattggtggcagcataagcgctaatactgaatagatatacgcattttttttcaaaatatctgttagtacatttatacaaatatattcgtttatacctcttctttaaacaggcgcatgtgtaaataaatatgagactgattctccattatgcaatcttctgatagcttctgcaatcgtagggctgatatccacctgatcgacaatgtccaaatccaaatcaacaggtaccgtgttggtgcaaacaattcttgataacctactatttattaacttctccctagctgagccagaaaatataccatgtgtgacaatagcgataacctccttagcaccgtgatccattaatgtgtcacaggctttcaccagcgtaccacacgtgtcagccatatcgtcaatcaacaagcatgacttaccagcaacatcaccgacaagcagcattcgcgaaacttcattagctttttgcctctccttatgaatcaaggcaaaattcatatccagcttgtccgctaaagaagccacccttttcgcaccaccagcatcaggcgataccagtatcgcattattgaaatctgttttggtccttatgtaattcaacacacttggttcaccgtataaattatcaaccgggatatgaaaaaacccttgaatttgtgaagcatggagatccatagtaataacatgatcacaacccgcagtttccaaaagattggcaatcagcttcgcagtgatgggcgcccgcgatttatccttcttatcttgtctagcataagggaaatttggtattactgccgtaattcttctgactgatgccgtcttacaagcgtgaattaagataagtaattccattaagaaatcgttgatttcatgttccccgtaaccagtttggatgatatatacgtcttcatcacgaatgctttcccctattgtaacagacgtctctttatttgaatactgatatacccccactttagataacggtacaccaagcctttgggaaataagctcagcaagcccaggatgtgagttaccagctaacaacttaatactgtttgtagacatattcaacgaaacttacgacaagatagtctttggatgatgaggaatatcctcttcttagcaatccctcgatgcctcctcatatcatctattgttcaaaattttttcattgttgaaaaatagtcacgtgcttaaccattttgctgcgcgatttggtaggaggataaatacacgggcataccgtatctgttcaatagcaacaatgtcggagagagctaaactagccaactcgccatcctattccactggtcgcttgagtcgatatccttccacagcaatattgcactttacaattaggatagcctccccaataaaataaggaaattttggttatttgtgttcagaaaaagccgaaatcgattgcagagaacagaaaggaactttccgattatcacactttaggagccgtgataaagaagactaccatcgcatatcgcagaaaagactttaaatattaactaaaaccgcattcgcaaattgcaaacaaagtacgtacaatagtaatggctacaaagcaggctcacaagagattgacgaaagagtacaagttgatggtggaaaaccctccaccatatattcttgctcgccccaacgaagataatattttagagtggcactatattatcacaggacctgcggatactccttacaagggcggtcaatatcacggtactttaactttcccgtctgattatccatacaaaccaccggctatcagaatgataacaccgaatggacgtttcaagcccaacacacgattatgcctttctatgagtgattaccaccctgatacttggaatcctggctggtctgtctcaaccattttgaacgggttactaagtttcatgaccagtgatgaagccacgacaggatcaattacaacatcagaccatcagaagaagacattagcaagaaattccataagttataacacttttcaaaatgttagattcaaattgatttttccggaagttgtacaggaaaatgtagagacattagaaaagagaaaattggatgagggggatgcggcaaatacaggtgatgaaacagaagacccttttacaaaggctgcgaaggaaaaagtcatctcgttggaggaaattctagaccctgaagacagaatacgcgctgaacaagcgttgagacaatcagaaaataattccaagaaagatggcaaagaacctaatgatagttcttcaatggtttatattggtatcgctatttttttgtttttggttggcctttttatgaaatgaagccattaaatgaactaaactttagataaattttgacaacacagaatagaaatcaatagtattatatagacaaaacggatctttttattatgaacattgtgaattattaattatatttttgagtatgtattgaccaagaaacctcaataaaaatgaggtgaaacctagggagacagaaactcccatttcaaaaaccttcaactttcattataagcttaccttgagcacgttgtgtagccatataggaaaatgcttccttgaaatttttccaggaataaaccttatcaacaacgcaatctacgactccctcatttagcagcttgccgcattcatgtatccaatcattcttcttggggataatcttgatattggggtcaaagtaaaaatgagaataatcgtatgaccataacattgatccaaacatttttcttgcattggcgctagggttatcccaagaatcaaagacgtctttcttataatttccaacataatcaccaactgttgtaatataagcacctttagcgtgaattaaagaactcgagtgactcaagatatcataaccaccgatgaagtccaacacgacattaaatttaccctgagtataatcttcggtttctttgagagtattaaaatcatcataatctacaactttaccggtatccaacatacgtctgagtggtttactagattttcccctacatgacagataatttatgaaaatgatttcatctttcaaatccgggaaatgttctgacaggactgctgcaccattacctgacgttaccactactagctttttagaaactttatagtaacgcttcaataactggatagcaaacatccctacagagcttgtaccaccgtttattaaaacattagattctgtattcaattgatccttctcctttagttgagctaacagattaagtgctgttcctaaacagaataaggagcctgctgccttttctggtgatagagtatttttgggtcgcattaaaataggatcgacacgcggatcaatgagcaacgaactttgcagggcgccaatggctaacttgggatgatagtaaatgccgtacacatcgtcacccacgttccatctatttgtcaaattatcaccgacatgtgttatcactccgctgtattctcttccaatgccggcttcaccataaataggcttggtgtaaccattcctaatcttcatatcaacagggttcaaacctacatagttcacttgaactaccagtttgtttttacttatgggcaacttaattttgttctcatatgaaaaagtaatgggaccgtgtttagaatgaaaaactaatgacttaacgggaatatgtcttacatgtcttaacggtctggcgactctagtcagcgtaggttcatccacggggattggcttcggcgctgaaacttcatggtccactgtcatcgcttctagtttagggtctttattttccaagattttctctgccatctttctatgctagtttaactttcttttgattgttacgtctttacttcctgcgtaatgtacccttcaacttaagtataatcgtgcatcccttcctttatacttctctttgtgtatagctggggcgatgtctgaaaatcataaaataggatgaataatggcgatagaaggttttacaatcaaggtcaactggacgcaagaaaaggctaagttaaggtaggtcttcgacttgacaacaaaacttcccccttaagagaaactgaacttgacctacagagaaattcgaatacggatattattggttctcccctcgttgtgagtaattccatttcaagcagtaaattcatggacttgtatcgccttgagcaatgtactcaataaaaagagttaggctgagtgaatccttaatgtacataatctatgcaccgcttaaaagtttacttgaagcctgtcgtttatctttagctaccgacttctgggcataataaccaaagtcatattttatcgtcattagagtgaaagtttttactgcgaaacatcttgacatccaagaaatttaaacccatacaatatatttcaatatttttgtctattactaaaagttcgcggagcacaatcggtcgacaattcgcccgaacagagattctgcctgataccgacttgcccagcccaagtgggcagagaggaaggagaaatttctcgggtagaggggagggacagtccgcctaacttccttacgaacgggcattgctttaggcaggaaagggtcctgcttcagcgtggacattgaaacttccattctgcgggacgagcttgccagcattccaatgcccatcgtattgtactcaatggtgaaacttaccaccatattgttaaaagctattatttatgatttttacttaccaaacattgaaaggagactgaacacaccacgataaaacgtatgttctgatacccagcaaatgagaaagtagaaggagaaacctaaaaacctgtggcggtcaagactgctagcaagatggatatttagatcataaattctaacgcatgcatcctgagcaatgaaatcatgcaacctaacatttgaggttaatatatgagaattaactagcgttgaggaggtactgcaatttaaaagaccgaagaattatcgatgcaaggaaaaatgggtctaggatgaatacgagcaattgaaatacatttggaataccttgtgaaaatatcacatactttcgccttctatctcgatgcgttattacaagaaaatagttttactaacaaattaacaaaaattaaaatagtgtaaaaatgggtatttctcgtgattctcgtcacaaaagatcagccactggtgctaaacgtgctcaattcagaaagaagagaaagttcgaattaggtcgtcaaccagccaacacaaaaattggtgctaagagaatccactctgtcagaactagaggtggtaacaagaaatacagagctctaagaattgaaaccggtaacttttcttgggcttctgaaggtatctccaagaagaccagaattgctggtgttgtttaccatccatccaacaatgaattggttagaactaacactttgaccaaggctgccattgtccaaattgatgctactccattcagacaatggttcgaagctcactacggtcaaaccttgggtaagaagaagaacgtcaaggaagaagaaactgttgccaagagcaagaacgctgaaagaaagtgggctgctagagctgcttctgccaagatcgaatcttccgttgaatctcaattcagcgccggtagattatacgcttgtatctcttccagaccaggtcaatccggtagatgtgatggttacatcttggaaggtgaagaattagctttctacctaagaagattgactgctaagaaatagagataataagataatattttattacactacatgtacaattttacttttactttgtgttgtctctatctgctttcttatttttaatatttaccattccatttataatttgtaaaacaattaacataaaagttttttaaactctagaccagcaacatatcttcaaatatcagttgataaggtaaagtatgttgatagcattctaccgtcacacttatctagcagatctttgttaggtagatctgctaatatattttacgtaagattcgttgtatgtgcgggaaaatttgtatctgttgtggtagtcactcaccctttctatgtattaaaaactgataccttccatactagaaaagacattcagttgaatccttctccaaatcaaggatactattgtcacttctccattgagattcgaaaaacccctcgggtcttgttagaactaaattacgttcataggggtgggatttatattgtaattccgcgaggtttacacgaaagatatctcaactctagccgcacatccattccggtatgtactctcccaccattgggtattatagaatgtaataggtttcaaagcggatatcttttgcccggtgagttgttactttttcattcgagcaatgaagtacattctagaagttcctagaaccttatggaagcaccaagaaaaaaggaagttaaacaaaacactgattcaataagcaaggggggaagctccttagtttgacgacagtaacaaaatgttcgtataaattgaacgaaactcaagccaataaaggacttttcagaggcctatctcttctttctccacaactttcgaataaaaaccactaataaaaagtaaataacaaaaacaagaaaaaaaataaacaaaacaataatcatgtcaaaagctgttggtattgatttaggtacaacctattcatgtgttgctcattttgcaaacgatagggttgaaattatcgctaacgatcaaggtaatagaacgacgccttcttatgtggcttttactgacacagaaaggctaattggtgacgctgcgaagaatcaagctgcgatgaacccacataatacagtattcgatgctaagcgtctgatcggacgtaaattcgatgatccagaagtgacgaacgatgctaagcattacccattcaaagtgattgacaagggaggtaaaccggtagtgcaagtggaatataaaggcgagacaaagacatttactccagaagaaatttcctcaatgatcttgacaaagatgaaggagactgctgagaactttttaggaacagaagtgaaagatgctgtagtaacggttccagcctatttcaacgattcacaaaggcaagcaacaaaagatgccggtacaatcgcgggcttgaacgttcttcgtatcattaatgaacctacagctgccgctattgcgtatgggctggacaagaaatcgcagaaggagcacaacgtcttgatctttgatttaggtggtggtacttttgatgtctctctgctatccatagatgaaggtgtctttgaggttaaggctactgctggtgacactcacttgggtggtgaagatttcgatagtaggctggttaactttctagccgaggagttcaaaagaaaaaataaaaaggatctaacaactaaccaaaggtccctaaggaggttaaggaccgccgctgaaagggccaagagaactctgtcttcgtctgctcagacatctatagaaatagattcattatttgagggtatcgatttctatacttccattacaagggcaagatttgaagaattatgtgctgatttgtttagatctacattggagccagtggaaaaagttttggctgattcaaaattagataagtcacaaattgatgaaattgtacttgttggtggttcaacaagaattccaaaagtacaaaaactggtttctgattttttcaatggtaaagaaccaaaccgttcgattaaccctgatgaggccgtcgcttatggtgctgccgtacaggctgccatcttaacgggtgaccagtcgtcgacgacccaagatttactgttgctggatgttgcaccattatctctaggtattgaaactgcaggtggtattatgacaaagttgatcccaagaaattcgactatcccaacaaaaaaatcggaagtgttttccacctacgctgacaaccaacctggtgtgttgatacaagtttttgagggtgaaaggacaaggacaaaagacaacaatctactgggtaaatttgagttgagcggtattccacccgctccaagaggcgtaccacaaattgaagttacatttgatatcgatgcaaatggtattctgaacgtatctgccgttgaaaaaggtactggtaaatctaacaagattacaattactaacgataagggaagattatcgaaggaagatatcgataaaatggttgctgaggcagaaaagttcaaggccgaagatgaacaagaagctcaacgtgttcaagctaagaatcagctagaatcgtacgcgtttactttgaaaaattctgtgagcgaaaataacttcaaggagaaggtgggtgaagaggatgccaggaaattggaagccgccgcccaagatgctataaattggttagatgcttcgcaagcggcctccaccgaggaatacaaggaaaggcaaaaggaactagaaggtgttgcaaaccccattatgagtaaattttacggagctgcaggtggtgccccaggagcaggcccagttccgggtgctggagcaggccccactggagcaccagacaacggcccaacggttgaagaggttgattagataaatacaaagatgcgatgaagtagcagcatcgaatttcttagttttccctcttaacaactttttataagtatatatataagatacacaatcagtaattagcaaatgactactatttgtacgttctcatcgtcataagccagagtttaattaagtgcctcaaccgggatgcgatttcgcgttcatatacaaagccgaaatgacaataagaaagtcatcgccaaacaacacgactaattgaccattaaaaggaacaaaatacagtcaaagagtttagctcggaaatgtacagcaatcataatttaaattcggatgactgttgcttcgattggaatgaagagaaggccgcagaactacagcgtacaggtgtttcttttgaccggagtttaacacctcaatctttaagaacatctacacgtagactatcagaagagaacaaacaacaaagtggcactatgcacattgacacttccccttctgtggtttcagatataatatcaagtagacgagatcgttcacaggatttttttgggcctcattcttcatcccctattgccccttcagaacgacaacgagcggatcagagatcacggttggagtccatgagattaactagacgtcgagacaaaatgaccaaagtacgcggtggcctagaaaagatggaagaaatgatcatgcaaggtgaacaccttagagaaatgcaaaggctaaagcaggaagcacaaaagaacgctctaccctctgacatggctgaatatatggaatggcaaaacaacgaggatttggaagacgatgagttgcttgcctttattgaaaaacaggaaacttataaaaatgaattagaacactttttgaacaatgctaataaaaatgtttatgagaacaactcgtatccgaactctcatacgtgatggcatcattgctattacagaaatagccctagcctgtcatatttaactgagctgttgagtatgggcatctttccgcatgcgctaactacggagctggctcttccccttctattaatccttctggcaggaagcgaaagcgactgatgtcgtttctacgtttctatgtatattctatcgcgtttaagtgtgtatattttgagctgctcaagtgaagggaacgtattcagaataactagattctctgccatacgatcaactaactgtttaccatatacagtctcagttcgctacggttagcgtaccgtaaaacagcagtttacattcactatataaaggatgacgtaagaatttgcctacgtattaaagaaaacttcacaatcaaactgctaaaatatacaaataattccgttcatttcaggccatgatgacgatccttcacataatcttgaacgggatcggtattcggatcatatttctccaattttttgatttgttctggcgcaattgaaccgcgtaaatctgaatcactttggtaccaatctttgatcaaccataccatttctttttttgccaattcgacatttccttcagagttttctatgatacgacttagaatgtaatagagttttaaatgagaaactccggcaagcaagaacattgaacatacagatccatcagcagctgaacttttatcaatgaatgattctaatattttattcattaagaaatgtacagggaaaacaacgtccgtatcgcgtgttgttttaccaattcgaattagtgtgttggatatcgaggaaagaaaggattcttggcctacacttcccacgtcaggcgatggagcatttttcatgctatcgagcaatcgattccactctccttgaatgactttttcatctttgaattgagatactttgaaaattcttagttttatttcgtagtaatctaatgggtctgcacaatcattaaagagatctgataatgggagcacccttccatttagtttaagtgttagttgctttctataatcttcgtcaatccttgtttcattccttaccaaattaagtaggtcatcctgaatggaagctatgtcgaaaagttcgtggatgttctcagataactggaccagtgccggcttttggtcgaatgacgttgagctatcacaaagaccgtttgctcttgctaggcattcgattctttcacttaattttaagtcaaaatcagaactagctagagcatataaaacatcagctgcttcaagaaaatgttcttctttgaataagtagaaccacaacagattactaatttctagagatttttctgctctttctttcaagtacggcaaaacaaattgagaatccaaacgtaataagtagtcttgtcttttatttgcgacaagccaatcataaaagcaataatggaagaacctgttattgctattcattatcactgagtaaactcttttcttcagtgacgaagctggtgaaaaaatagatatatttgcaattgaaggggattgttcgatagatgtatagtcatccacgcttttgacaatctcaaaaatcaaagtgtacacatttatgcgtttgtcataaaaaacttttcttggatcggcagtattacaacctctagacacatactcttgtgcttggtttcctttatcaattttatctgcaaatctaagtagaaatccaacagtcttaggctggtaattaagttttaccatgatatccaccacacgtctcaattcacataattctatattctcggcacacctttcataaaggtcaattgcggtatctaaatggttccttgatattttagaatctatcatttcaaacttctgtgctgcttctaaatgctctcctgccctgtaacacaaaatgtctgcactatgacaaaaagatccaaagcgttcctttaaaacgttcacaatataatctgccgatgtgccgcttgcaatattagcgtttacaacttctattaaaatctcttttattaattgtttggtttttgcgttaggggtaaacaaatcatggaacttaagatcaaaaaaatactcacgtgtcttggagtcataaactccccctgcacccatcaatgtatttagcaaagatttgaaagcatcaatatcttcgtagaagacatttataagggaaagcgcatccttaatagaatttattaagaggataagagcattcatagcaatagactcagcatcggatgcagttatagcattgctacctttcggaggcacaaatgaaacgaaggaaggacggtggatgttgaagaaatctgccaaaacagatatcgatgataaataatactcaacctgtggcctagttatagaaataccaaaagcatccattttttccgttttggaagcccttttaaaaacaaagaccctctcttcccatatttggctaaataatcttgtaattaataacgcagaaccataaaacctgggagatagtactataccatcacattcaccagatttatcgaataaattttgtgagattggcggcacgctgccactttctctagaacttttcggttttatttcaactaccccaggtataccggcagagaagaaggccagggcacttgatttaatatgctctgacttattaaacttacaagctaaataaagtgccgtagagcaagcctcagataaaccataactgtgaataaatggcaaaggattttcaatcaagctttcgaacacttcgtcgggcgtgcgatagcaataaatttctaaggcattgcttgttaaaacggcaacttttaatggttctgcactgtattgtgaggcaaacacattggcgtaaccttggggagtagaagtgtaattaaaagatcttgttaagggaacaatctctttaatttcatctgtcgtatcgagtagtgcggtattctctacatatttaccataattctttaatataccgtaatctggagcactaacgtaaagtttgtgttcctctttattttccagcaaagctttatttgtaatacctttagatagttctccggaattagctcttttcctcacgcacgtaaagtatatacctggtgatattatcgtactagcgcaagtggtattgatataagttgaactagctttttgtgttgaaagtgggcctgtatcatgtgtgtttaaggggtgatgaccgattatgaaagatttattttgctcgagggagctagatatactggtaggaggaaactttacagagtctaattttaatgagccaatcgatctcctagaaatggaacctttgaaatacaagcgtaccccagtagtagttataacagctaagaataaatcattgttctcacacatagagatagaaacaattttggcaatcttgaaagctcgattactgagtagaggtgaattttttacacccaatgcattcattccacgcctgatatgagcagcatcaatgaggaccggtcctactagcccgttactagtaattaggtaagatctgacaatagatttcgttgatagagtatgtaaaacgcctcttgactggtcaacttcgagctgtgatatagtttcttcttcggtacctgcatccccttctagtactttttgtatcaactttcctccgggtatgctaggtattagttttgtaggtagtaaatttgctaagtttgactttgtcaaacatattttgttactcttgctattgaataggttctccgagcagttatattgtaattcccacacgttgacaccatcagtcgcaccagtgaaaaatatttgtccagtcctttcgtagcttattatgttagaaacgttgaacccagttacatttacttttaatcctgtgttaaagatattcaactcatgagtacggtcattaaatgatattgtcaaaatatagatatcaaaaagagtggcgacaatcaataaattttcaacagaagaaacaaaagtgtttgggctaggcttaactagtttcacttttaaaatggtgtgctcgatttcatcgatacagtggtattctgaactattattgatattccacaagatcaatttattatcagaggttatccaacaatagttcagttcgagaaaaatacccatatcactctttatttcggtatttgaaacttgtgataaaacttcatctggtatatttgtcacttgttgtctttggaagggggtaaatgcacctaatccaccgacttcatctgagaaattataatccaaacctttactataatagtctggattatctagtattggcgtatttctgtccctaaagctcaaatcctggacaaattcactagccaactgcaacggttcagaggaagtcaacccgcttatcttgacgtgtgtagttacgtcacgaagttctgattcaatagtatttccagcctcgccatacttgtttaatacatctttcctggtttttctttcgcttaggaaggaacggctcgacaggttgggcttaccgttgttttggtcatctcttggccgattccttaagcgatttcctcctaaggaagccgaagccgtaaacgtttcgcgatcgtaatcaatcctcttttttagtggagttgaatacatcacaattgaaatccgagctgtagtttttgtgaaatgtttctcctacaaacagattttattcttaatttcttctattgatttataaagccattcaaaattcagatggaaattattcattagaaatctttcctctccaaagtcgggtaatactttctattttgtgtcactaattttataatactttaatcagcaaatactataataatagaataatctccagacgttcatggaaagttcaacaatggaaacatagccatatttatttactagcaaaagcattttcagagaatttttttgtttcctgaaaaaaaaatgagggaaaaaagaacaatttcaaataaagacacaaactatctcaaattcccaaataaactccaaagatattcccgattcttgagcaggaagatatccaataccagcccagaaaagcaaccgaagaagaacataaaagaacactgtttatcgagttatcataaagaacactcggtaaaaccaaagcaaaactccggtaatgttgcagcaaaagaagacaaagatacgcagcatttacaaaataatgtcgctaatgaagaagcaacggaatgtctaacaagaagtaatttgaaaaagttacaagagaaaattttcgatagagaacttaatgatattgcctgtgatcattgtctttgtagcacagaaaatagaagagatatcaagtattcacgactttggttcctttttgagttggaaatgagtgaaaactggaatgaaaatctccgccttagttgctataataaatatgtgtattccgcaattgatgagtcgtggaaaatggagaatattctacttaaagaacaagagaagcattatgaatattttccaataggacaattactgatacccaataatattgactacactaataaacagaaaaggaaggaaaacattgaagacttaacaattgaaattgatagtattatagagacaaaccatcaaaagaaaagatttttgccgcaaagtgtcctgataaaaagggaggatgaaattgcatttgacgactttcatttggatgcacgaaaggttctaaacgatttgagcgccacttctgaaaatccattcagctcttcaccaaatacaaaaaaaattaaatcaaagggaaaaaccttggaagtggttcccaaaaagaaaaacaaaaagatcataggtgctttggaaagaaagctacatatagatgaaaattaatgaaagtattgtctgcacattaccaccggttaaaacggcgactcagtgtaacctgtaaaactttttatcaattttgaataggtatagagagattttcctattctctccaaaagaacctgtatcattaaaaaatatatatcttttacatattgcaaatataaaaaattacaaaagtaatgtggttgcgcacggaagctatccgaagaacgaatttcaccttttctttttctctttaacctcttcatcagttgtggcatgtagcctaatgacgtttggatagtcgggtctgttgcccatatggccttgatgccaatcataacttagagcgtacgcaaatacgctaccattcctattgaagctgcatacaggaatagatgcttgcaaagtaggatagcctttcaatctatgcctttgattcttatcccaaaaattgaaggtaccatcaccaccagccgtaacaaaagtaccatataatggatgaaatgcaatgctatttacaggatacactagagattgaccattggagccaggtgccctattaggattggtttgacgatggcatttaaatgaaaagcctgattttttctgcataccatcatcgatataccttatggagcatctaccttccactgaaccaatcgcatatccatcggcttcattataacatgccacgcatcgagtttgccattttaaaggtgacgtggttgccttaaaaatcgttgttgggtttgctagattgataatagcgatatgtctttcggcagtagccactactaacagagactgtttattatccatcgaatatactctttcaggcatcattacggtggatacgggctggggttgtctcatatcccaatattttatggttttatcccaggatccggttactatacactctgtgttcgatggtccacattgtacaaaacgtaatacttttattggcgcagaatgcattccaatttgctgtgtttgaccactggcaatatcgtacaatttcagggcattatcacacccgcctgaggctacttttgtaccatcattcgaccatctggtacataatacagggctggagctttcatgctgcgctctaccttgaggtacaccattttggacatcccaaatacgtaccttaccgtcccaggaactggcactaaacatgaaatcttgttgcggtgaaaacgcaatatccgatattgagtcctctgctgggctattaatgacaatatcattggccaaatccttttcattcgccattgcagtactcgttcccaaagctgaggttgtatttgatcgattaaaaaaagacatagttccccacttttcctcttcttacgtatttctttattttattgtaatatgcagattaaggtttatgatatttgatcaaggtggatgtgccggaatgattggtatggtaagcttgcccaattcttataagtcagtctctgttcaagtaaaatggttatatagtgcttaaccggaacaaacctttagcaattgcgatcaactaagatatcttattgtaaaccctaccgtcatcatatgaaatatcaatcttagaaatcttagagagcaatgcaaaaaaaaaaaagagacgagacggtcatcgtaaatcatgatcatagtaatgtcaaaagttaatttaccattatgccaagctacttcaatgagtgtacatcaaccagaaaagtgcctgtatttaatggttcaaatgttctttttataagtacaatatcttatctaaaaattaaacacttctatcttatcatggaagaaaaacaaagctatcacaaaacaaatatcctaaaaaaccgtttataaaaagtcgttgctgtgaaaatggttcagttcacagggcttaaacccatccccaaatttagcgaaatgtcagatacgtaactccattctcctagctttttattatgtttcctgtcattaagagtttttattttttattataatactcaacacgtgacttcagccttcccaattaataaaattgaaatcattttcatttgtatccagtaaattgagatcgtaatccggtccttggtcttcaaccataccaatattcccaaacttcaagttctgagagtgtacattctgattttcattagtactggtttgctgaggacccaaagttgtacccacattggatgagggctgaattaatgtgttatcattatcgccactatttgtagatgcagaggtttcatcagcaacatttgaattctcgtttggtgttctattgttagaagcataagcttgattaggaaacaacaaagaacttgaatttttgagggcgtcaaaatcatatccttgattattactactcggctttttttcctctggagtagataatgtgttacgattgcctttactacttcttgaatcattgcctacttgcgcctccagtatgtttcccccattcggcaattcttgggatactgtattattctgtgaagtgattattttagagttctttaaagtaatattcaaattggtggttgaaaacccatgtggcggctttataaccacgtttcctggtaccttagaacttctttgcttctgagcgtcaccagaccgaggtgttgctatgcttaatggggatgatgccgaaacttttgagtttactgctcgcttgggtccattctttccggcaatcttgccactttctggatcgaagcaactctctgtcactgaagataatggactggatacagccggcttgttgaaacttcccaaatttatacctggaaaagggagagaattcgcagttttagtgggcggagcggaatgaatattcggagcaatagtattcgagaatgttcttaacatattattctcatccttagtggcatcagcattcagaataacagaaggagtggatttcctcctcgacactctagtgttagggggactgcgctttttacctgtcaccacgctgttgccaccgagtttattcgtagactctactggaaaagctgaggtggatgccttttttgtatttttccttacctttgtgggctgtttagaagctaaagcggaaggtgatgctccatccaacgatgggctagatttggaattagaataaatatcttcctcgccaaatattattgcttgattgcggaagttagtagcaatatctgatcttggagtcttatttactcttgaacctaccatagcgggttcacttgttgttgagcctggtgtggtaatatttggcgaacaagcgttcgtcgatcccgcggaaactgtagcggtattattttttcttcgtctcttagccactagaccggctttaactttacccttcgcttttgaggttgcagatctacttcttgtagattttgacgtcgggacattatttggtttatctgttgaatgcatagtttttaaacttttaggttggttcactggagatttgttattagttgtattatttgtggtattattgttacacgggtttcccactggattttccgtagtgggttgcattggataattatagactggccagccagtaacgttttgactccgattctgggttggccctacatttgtaaaatcgccggaaggcggcgctgtgggagcaacagcagttgcaccagtcgtggggtttgcattattgtatggtggaatggaaaaattattaacgatagggttaccaaccataggaattggtatagggttcatattaacattgcgcatttgaaccgcaggtgccataggatttcctagcatcatagcagccaagtgcatggggtctatgtcctcgttactatattcccctcttcgttctgcatcgtgttgtagccttgccgcatgaacagccaagcttctatatatttgttcctgcctttgttcttgaagaactagttgataatattgctgagcgaactctgagccacctctggaagaactggtattaaagatgtcccagaatatttgctaccattcatacaaaaagccttgaggtgtatctactaccttcgagaacgtattctggttaccattgttttctttagatttgggtccgtcgactgggttttggcctttgtctctatctaggtgcgcatcttgagcaaaggctgctgcagtgtttttcaaagacgacttcgtaagaaagtcaaatatgtactcattgagcgtattcttgcagttcattttttccttcaaatccgaattttccgccgtaggttgatttatccactgctgttgctgctgttgctgctgctgctgttgttgtcgctgctgttcactattcgttgccattgcaatattactctgcaaatcttgtttatactggcttgccatgtacggttgttccgtgggaggaattgaatctggatacgaactattcactttataactcattctaccacggaatgcgtttcctctttatttatgtctataaacgtcttcgtgtttattttttatagcctcagtgacttactaacgtcaactcaccgtgtcttcggcaaacaaaatggtatcaaagcaaatgcgcttgaacaggagtaaaaaatggtcactttttcaatctgtattctatgaattttatcagtaccggtctcaaaccaaccctctacaacttcatcgtgatcccattctttcttcgttgtcttcccacgctcttccggaccctcgtaaaagagtccgaagccgagaaggcgcgatttcatgcactatacactcgttggcaaacacaacaatggaccctggccagttgaactgtggtccctgttgcgtccactattgatatgcatgcatgtggacgcaagcacacgcctgcataaacgtttaattcctcagtatcccactcccagggctacttattcgaggcattttctatttttgttactactagagccagcattagaactggaaatacagcaaaaaatttttcacattcttatcacaagaatgtgcaggagaaggtaaaacctgcaggtaacttgcatatatttcagtaaattacatgtactatacatcgtcaaataatttacatttgtacaagaccaatatccggggcccgctaattagtaacgtgccgtgattctttcattagaacaagtacaagatgacctgaacttgcgcgtattcatatggaaaatacgcaaggcccggttatttccgttctgggatattcgccgaaagctgccttctgttcgaattgcgtcgtcaacatccttttgagctttctttaagttctttccttcgagatggacgatgccaagagaatcatcgctgagttgatcggcggcgtgtagatgcgccgatcaactttacaggacgaaactcacataaccttaatacaataaaaaagtattgcatacaataggtccctcaggacacatacatacaagattggcaaaagtgaaggcaggtgcctaagattgggtgggaaagtaaatttacatatagttttttctaggaaaaaaataaaaataatgaaggaaggtatacttatataagcgctgtttatcgaaacagacgagaataaaaaatggttttaaaaaaatcaagcaatgacggcagctaaaaccggattttgagcaacaattccgttgtaagtagtgtttagatacttcaataattcaataaccttatgcttcatctcttcggtttggaattgctttaatctttccatattctcttccctacctagagtagactccttttctaacttaattctatcattttctttggtaaacacagcactgaaaatctcgatgatccttggggtttcgtttgtgataacgggactattttcctggtatagtttcatgatcaattcgaaaattggattgtattcttcaaaaccggtgtttagtggtaaatgtgccaataatgctggaacagtttgttccaatggaactagagcactgttcttcaaagccattctggccacacatccactagcattagcgtatgctctatcaataatctctctggtggcttcgtcatcttcggctgctaaggccttttggtcagcagcacttagtaactcataaagcgccttcaaaacaggttcataaacggctgagatgtccatagaagcatattcacacaacaaaccaacaccataagccgcgttacctctaacttctaaagatttatcgcttgttaatctaatgactaaggcttctagcatttcatgaacgaaaggattttgttctttcatacctagagctaattcagaggcggcaccgacggcggatgatctcttattcttggatttagattggaataatccgaaaacaaccggtctgaagttgtcaaagactttggcaaaatcaccagctaaagcttgagataaactgacaagaacttccaatgcaacatcttgtaaagttgcttcggtttcagaagcgtctaattcttcatctcttggaacgtcctcctcgatatcaatggtttgacaagtatgggtacccttcaagacactaagaacttgcatgcacaaagcttctagcatagaagagtcgccgttgtccatgatgatgattgcgccaaattgcttaatcatattggcaaaatcttccataacggtaatgaccattgaggtttcgaattcatcgcttaagttacccatggaagtttccctggcagcttgaataaccgccaaaacatcagcattaacgtaggaagaggctgggatacccttaggatagctttctggttctactttggaagccaacaggacagacttaacaacattccagatggtgtttagagcggtttctcttaaaccgtacgactcatcgacttgttcattcaaaacctttaaggattgttcgacgtatggcaagaaatgctccttcgtacccaatgctaattcggatagagctgcagaagcaacttccttttcataggaaataccagtgttaacggtgaatttgttctgtagttcttcttcattggcagaatcagcaaatgcggctaaatcctctgcatcaccatcgaagttgaattggtattcatctaattctagtgtcttgaagatttctggtaggatagttttcaagaaaggagcaaaattttcgccgtaaactttagccaagtttgcaatgaatgcataaccagattctcttaatctagcagaatcagttttgatggcctcataggcggagttaaccaaaggttcggcaaattcggcaaatgcgtctgatctgacggctctggccatagtagaaatattttcaaaagtgttggcccttagttctatatcatcttcgctcataccttcaatttgagaacagttttggatgaatttttccaaatagtgaacactagtcttgaaatatggaatgaacgcggaacctgctgcaaaagcagcggaaccaattgcagaaacaacagcacatctcaacttggatgattcattactttccaacatatagaatagtttgttcattaatggatccaagtacttagcgatagcatcataagcaatgaactcaagcagaccatctaaagcaacagttgcatagttgtaaatgacaatgtttttcgcagaatcaatgatatcgatgatcaatggcaagtattcttcatgaaatttggcaacttcgtcttgtaagtcagtggttaattggtgaatacacttcagagcagctaatttaacaatcggttcagtatccttcaaaccgtttatggtggcagggataattttgtcgaattgagacaaaatgtagtctggagaaccagtaacagcaacggaaatagctaaaagaatagctcttctctcaaaaacgtttgcggattgcaacatagctggaatgtgttcaacaataacggaagcaacctgggatggtggcagttcagaggaagcgaaagctaacagtctaatagcagaagaagagggtgtattttcctcattttcgcctgtttcgtcttcgttgtttaattcatcgtcaacatcgatctcttcacaagccaccttcaaagctgcaacagtaatttctgggcccaatttgctttgagaaaccttcgattttctgtaggacaatgaagatatgatgaattgaagagcaaaaactcgaacatcttcgtcaatctcactgttaacagcaatttgtaaagacagcttaatcaaatccacaataaagtttcctgttaattgggagtccaatagcaggaaatcgtttaaacagttaaagattaatttagcgttcatggtgtcgtcggccttgataactgcgtctaaaacgttaaccacagatggaattgaggcggcgaatttttgagcttgaacagggttgatggtttcttgttcttcaatcaaagcagaaacgtggttcaaagcctgggcagataatgatctgatctccaaagaagatggatcattaattgtctgagagaacaaagccaaaaagtcatcgatgtggccagatagagaagaggtgaaatcttccaacagagaaaacaaaataaaaatggcagtttgtcttgtttgaacgtcttcaccagaagcagtttggattaggttagggactaaatctggccatttgttaccatctagctcttcagtaccaatagaagcaattactcgagcgttggaatgacgaacattttcttttggctcactaaatgctgtttgtaaaagagatgttttgatggaggctctagtggattcatcaatggcgttccagtgcttggaaaccaactttctagcttcaacaccagctagttgtttcaacgaatcatcggagccgttctgcaaaatatgaatcaaagctggcaaagttgtaggctgggtataaaattgagtttgcaaagtttttgtagcctccttcaagcctacaccagaagtgatagcgtgcaaagtttgctcaagttgacttagaaattgttgatccattatactacttgatactaaaaaagtgtttttcgtccctcagtttttatgctgctaaggcaggattttggtaatatacagaaacgagaagaaggatccttgcggggtcttgcctattcttttttgttgactaataaaatcaataccaaacctgacaacaaataaaatgaaggatctatggataagtggatgtttctatttttttttttttttttttttttttcgacctcatctcatcgcgctttccattcatcatattgtacgaaaacaaagcacaatcgtaataaaagacatcctgataattagcaaagggctaaccataatagtctaagtttagtagttcaaatgtttgttgacatgcacttgaagcaactcaagcgcaatgagaaaagtgactatacaaatatgtaaaaaattgctaccaaaaaaaaaaaaaaaaaatttaaaaactctgataatatagtaaaaattattggtacattgtgaattaaaatttatgcgtttgccctcaaatccttttctatatcgtccaattttgagtcaatgttctcaattgtgataccaatcaagtttctgtatttatctaacttcaccgatgaattaattttgcttttagcttcgcttattttcaatgttgtcatccttcttttaaactgtagaatagttagttccgttgctagtctcaacgtctcatttacatcatatgattcttgtacagtattagaaaatttggcgtccgctttggtgtttttaggagaagaagtttccgacgttgactttggaattggctcttcatcttcctgtttttctggatgtgaacttgagttagtattcatatcaacctttgattcctcatcctggacaattgtagccagttttaaagcttgagatttttccaagctttgaataaaattttgcttttcagaattcaactttgacgatgtttctttaatccttgattgtaaatctgatatcgaatttatgggagttttgtttgatacggaatcgaaagcatcctctatttgatgtgctattgtaatcaatctcttcttattgttagaaatagaggattcggtttctactacttcgttgtccagatttttaatttcttcacccattattctttgtagagaagaaacttttgtatttaatttgttgatctgctgcgaaagcggttttgagtactttcctagtggagacatctgtatcggcagaagggaagaaggcgattccaatgatggcatggcagttttcacactattcaagggatcctttttcttttcaacttgattctcattatcctttgccttttctttttcatctgatattgactgtgatcttcttctgtataaaatgggagagttttcaagaattttggacggcgtagactttatatctttaatgacagacgacgtcacgaaagaattaatattcgacaagtcttccataatagtgttcatatttgtagaatttggctggttggaatgcaggtattgactttcgttgacttcagaatctgttttagctatattgacatctgcagtagaatcttctttatcaggatgttgagtttttataatttttggaattttgacattgttttgtggttgctgttgctgttgctgttgttggtaataattcttttgaggaaggtttcgagctaactttcgatctgccttggtgttgttgtttctgctgtttgacccgccagccggagtattaaacttattcattattgacgcaggcgattcgttatctagattcaatatatctgttgacgcaccaagatataccagtctgttgtaaacctcgaagttcaagtttaaagcagataaatgcagtggagtgttccctatattatcttggtagttcaaacatatcttcaacaaattgtagtcctgctgacccaagctcaatattatcgaatccatataagattttattatcattggatttttggacttattaacgctcaattcaattaaataatgaaatggcaatcttccatttacgtcgggagttataagacatatttttaagatggatattatttcatcgaaagcattctccttgtagcaattgttgtagaaaattgattttgtgatgcaattaaaaccgagcttattacactgtaatgcattagcatttaaggtaattagcatttttatcaaaggaatattcgccatagctgtagcccaatggagtggagtgtgaccttgatcatcaatttcaaaatttatgttaaaatttttgggcgccggatataaagtagccaacaacgcttgatctacatcagaagacctttccgatgatagtattgttaatatcgtctgcttgtattcttgatctgtcattttgttttccaacttgttttgagatgaagtatttcctgcgctgaacggtgtcatagatcgtgaagacatattcatactgttatcattttcatttgatgaaaatacttcaatggaggagccattggatgctacagtgttgttgttattgttgctgccgttactgtcacagtactcattatggtgatcatttggattttgaaaggattgccataataagggttgcttcattaatttgaaatgcctttgtattttttcttgctggttgtaaaattgttgttcattagattgattcagctttttcctcctttttttactattgccatttgtaatggagtccatcatggaatgattgaagttattcgtcaaatattcatgatgatgttgttgttgttgttggctttgcataggtccgtctggaactatgatcaagttattattattgccattattattgttattactgctgttaatgacattgtcgatgttatggctgtaactattactgtcattattattagggttattcagagcaacgttcttgttttgtaaatttgtcggaattggaaaaaattgaagaggtttctgagttgccgaataattattattgaaagagttttcatgaatggatttttgttgttgaataatagtagattgattgctgttgttactaatattatttattaaattgtgtcttgtgtcattgttgaaattcatcgtggtgtggttatcattattgttcattatattcattgatgaatttacttggaactgttgaggagtttggaaaacaaggttttgtaaaggacttggattcggctggttgatcgatgcatttttcttgcctttcttattcgcagctgtagttgtagccgatgttgatgaactactgttcttttttcttggtgttttattgtagctcgatggagaagttatcttcgttcccggcgaagtcttcctcaatatactatttttgcttctctttggtggagggttatttggatcgaattgaaaagttaagatggagttgaccacagggtcaattatttcgtacttattgactaaaaacttcgctgaatccagtgggatccaagtaccttgaaacctaccatacccaccttgaactttttcatgttgcatatcatttgattccttttccagtattttagttcttttcgtcttcgaaaattgagctattttgaaaacctgggtaatattaatccaatcatctttagttcttctcatcactattttagtttcaaacccacgtatatagcattcgtatacatcggtttctgaatacgtagctatttcaatcactggatggtttgaatgaggcgccaaaagaactgattttgatattggcgtgatgttctggtgattggtattatctttttggtttgatatcaaaacatcaaatggcatgatttctcgaataaatcaaccttttagaactacgcaagagggacagaagggaaatgagaaagaaagaagagttaattttcggcaaagagcaattattgttgacaatatatcaaataacgtgaaataatgtacctttttttcaaagggtaagtggaggaagaatcgtttgaaaaagcgacgaccaatgctagatgtgattctgctgtaacaacaattaatagtaaaaataacacaatacactaaagagtttctttttttattatctcgaaaaaaaaaaaagcttccagttgaatttagcagcaaatattagtcaattagttgatatgctaaaccaatgctaaaggatggcaataactataatatcttttgtgcgtttttcacgttgacgtgcttcttagtccttgttcctcttttttttttgttaggttaaccatttatttcctaaacgggaaataagcaggcggggagctgaatataattaactttcgcgtcatggttagtgacgcgtcacttcaaacgcgggtaacaaaatcaagttgtttttagccgccgaaggtaattgtatccataatgaaggctagattaaaccaataatttgtagtgacaaaatttatagtcagtagcaggttctctttaaattgagagatttcgacagccttttactagatgtctagtttagtaaaactaattttcgtatgctgctaaacgacctaagatccgcagtcacctatcgtttaaagtacgcagtcacaatgcggttgaaatgtaatgtacttatattacctccttcttaagtaacatttcattttttccgccaccgtacacagagtaattgcttcgttcgttatctacttgtactgaagtccctctaaacctactgccttttatttttaggctctaaaataaccatggacaacgtgaattgggtagcatcttttttttaatagatagtttattatgtataacaataatttaaagatattcatagtgataagtaattttaaatgagtttaaagtactacttttcctttaccgccagtttcctgtactatgaaaaaggcaaattccgcattgtagccgcccacacgcattttgatcatcaattacgaaatttgccgcacacgtgtcacgtgataagcactcttactatcatgttttacggagtagcaatgatgttcaattattgcagctttctttcgtgaaatcgtagtatcatagaccttcctaatgatggaagcggtaaagaaggaaatcgtaaaagtaaattaacgaagtagtattagtaaaacagagttgaaaaactgataaatcttcaactcgaactgaaaagaaacacaatagaatattttttctcaatgctacctttatatcttttaacaaatgcgaagggacaacaaatgcaaatagaattgaaaaacggtgaaattatacaagggatattgaccaacgtagataactggatgaaccttactttatctaatgtaaccgaatatagtgaagaaagcgcaattaattcagaagacaatgctgagagcagtaaagccgtaaaattgaacgaaatttatattagagggacttttatcaagtttatcaaattgcaagataatataattgacaaggtcaagcagcaaattaactccaacaataactctaatagtaacggccctgggcataaaagatactacaacaatagggattcaaacaacaatagaggtaactacaacagaagaaataataataacggcaacagcaaccgccgtccatactctcaaaaccgtcaatacaacaacagcaacagcagtaacattaacaacagtatcaacagtatcaatagcaacaaccaaaatatgaacaatggtttaggtgggtccgtccaacatcattttaacagctcttctccacaaaaggtcgaattttaaacaaattttgtattataataattatgtacatatataaatatattggtacatatgtactgtgtgtgtatgtgaatgttgattaccgttttctttaaaaaaagcttttcttctttttattaccgagctttcctttagtttacaggttgactttctggtggtatattttatttataaaccatgaagccgttaagtaacttaatgcgccaagccctaaactgcacattacgttgaagattaaactataacaaatggaaattaagatagatgaaaacccatggatgtttagcactgcgaaaatgtaatatagcgaatacaattccatatatacaccaccgctaaatcccatttcaaagcacttccatctccaattgttgcgaaccaccttatcttcgaagcaaaatctcattaataaataacttccaataattgatatctccatagttaacacgcataatagtatgatactcaaaaaaaggaatccgtaaaaataataaaatgtagttttctccaaccagagagatttgtaaacgtattgcatttccacgtaaattactaacaaggggaaaataccacataaataaatgccgcagtaaaccaacgggttgaacttggctcgtgatttaggtacaaataatccattgccatcgctattgctttcatctttagtaattccactcaaccaatattgaggcaaaggtatattattagctacaataccaccaaacaagctgagtggtatacagacgatgaaataaatgctcatgaaaaacacaatagtcttgaatggtaatgcacttgtagaatcatgtgcccaaacaatactatttaataaaaatgtgctcaccattacaatgccaggtaagctggacccacaaagtatcgtaaaaatgggactaaacttcttgtagtctttgaggtatctgttatcgtcaaggtaattggccttggttcttttcgttttcgttaccatactgagtcttgtccctacgaatgatgccatgaatgctccaagtacgaaaaataaaatggccatagttagcacactgtttcttacattatgcaatttgttcattgaacatgatatcgttaaggatccaattatggtaaataaaaattgcaccccaaatgagaccagaaggattaaaacttttaaaccaaataaatttggtctaccattttgtatccagtctttcgccaccgtgtaaacggagtatttaccatacttgtcatcgtccaggtcatcctctgtttcaattccttctatatttatcatgtatttgggggactttgaattacttttatccgtgtacatgactcgtacgtaaataataagcgtgataaatgagatggacaatacaattcccactgaattggctaagctcatccaatgaaactgaatgctctgttcgtcagataactcacctgcgttcaagaaataatcccatctatgattccagtctacttcaaattcttccctccaatatacggagtaagtaaatggcaaatatgtcaactcattttcatcctcaggaatgactatttcgtattgttcgtagttcttcgatgccccaggacaatgataatctgacacagatcttggatatacttcaaagccgactatggtatttttatcattatcactggcatgaaaacgtattaccagcattacgtgattatgcagataggttttatctgtatcaggatctatgaaacctaaaggaaacccagatgcataatattttttatgatcagtggtggaaataaaggtagtggcagccggcaattcatcatcaattagccattgtacgacgtatccctccctgactaacttgtctaaggtctgcatgccctctttggtagttttccgggcacacaacgtttcacatggattgtcttcgccaaatttgagtttatagtcgctttcccatttcctatcccctcttattatttcgtttagagataaatgaagcggttttttatgcatagtaggaggacaagtgaagggcaagtcataatatgcgtatggcaattgcgttaagtcagattctaccttattcacaatcaattccaagggatcaccctttctatagaaattgggtgttatccacccgtcataaagattcttttggctggaggagatgactggttcctgcccatgccctcgcgttcgtgatgagtagaactggtttctgaggatgagcatcacgactactatcgccatgagtgttatgaccgacctctttggtcttactctcattttttctcgtttcggttcacgtctttatattagtgcttcagtacctgatgcaagaaattcaaacggagaggaagcagtctagtgaagaaaaagcgtagatatactactatgcaattttgaaaaataatacgttgctttgttcatcgaagcaaacgaacgaggtgctttggaatgtagatcttagagtggaaaaaagtaaaacaaaaaaaaaaaaaattgaaatatattttccattttcgcgaatgcgatttcgacaaattagagacctcttagaagggtcctaaaattttaatagccttgaaacagaagtcactaaacagattaacggcatcttttgtttagctttcttgtaaattatatatggttacaaaccccaatccctaacctcacgcaagtaaaactatatagaataacatttaaaggatcatcggcatcctttcattttcaaataactccattcttttttgcccatgagaacaatagcttaatgagtttatgcatcaaatttgaggcgcatctttttcaatagctttaaaattatattttgtcggttttatgttttgaattatccccgaagtaatcctcttccgttgagaatttaccctttttctctgttccacgcatactactattgcgagccactccaggcgataacaatccggaagctagtaagaacggactggaaaatccatttgagccaatggttgtattgttagcagaggacaaattcggagtagatatagtattatcctcgtcggaagttcgttgggttgacgctgatattgtgcgatcagcttgcccttgattattgtcatgttgctgctgttgaagctgctgttgatcccataaaaactggtcctcatcttcctcgttctctagcatttgctgttcccttagcttggtctcttctctcgcttctgctaacatctcttgcgctttgctcaaggaaaccgtaggtgttgtataggaactgataattggcactgatgtgtcgatatcaatggtggttttaattagtgcagccatccaacctctcatctcttctttattatctactgcaaaatagtgcgtgcgaggttgtgtaaatgtcaaacctttctttgatcctggttgcggaggtaatagtttgaaacaataccgtcctttacctgtactggctgcatataatgaaactagtttatcatcttccttagcaggcacaacgcgatgagcagtaatgtcgataagacctctttctctcgtgtccgtagtggagctgaagtatgacaatctagtaccatgcaatgtgaaaaatctcgtcttccaagtactcatggcaccgctgcctttcttgctcatccaaccagaaaagtcagcatccttcattgcctctttaacactaatactccttaaaccttctataaatgcagaagtttgctttttcttggctacaggtctagcggtcatttgacgcaagcttttgcccttgagcgtttcacctttaatagcctcactcgcagacctcttatttttatcatctttcacagtttcggtaaagatttcagcttcctttgcgctaactgatcttcttttagatctactctttttggaagactttttatcaactatcggtgagctgtttttttctgacggcattgaggttatgggattctcttcaggacttgaagagcgagcagcattatcagtaaattgttgcctaaagggacttagcatgaaggaactttttttgaatgaactagttcgcgatgcactgctgcttctctttaaagacgagttcctcctggaatcgctttttgatttagaagataatgaagacgagtgtctcgttggttttttcttcccctccttctcatgtgccaatttgtcattacttatggatgcaatggtagatccatcagcgtatatactggacgtgggtctttcgaatgtgttcattgtttcttgaaactgctcttcctcatggctggaacaagaggattttctatccgaagaagattcaggagcgtatccataataagggacagaattcctcttcgaagacgatgttagcttgccttcactatcttcatttctaacagaattacgggtgggggatggaataggtgacaacgccttcccaccgccttggttgttctttgggagtgcggaacgggaattgaaattagaatctgatgaagaatattgatcgatataagaagttcttttaggccctgagaaagataaagtaggtgattgccatgaataaagttgagcaggagaaggtgacgtccttgtgttattcaataggggcgattttggaggttgtgctggactagggtaagatgggggtttgggggctctcctcggagaaacaaacaaattttcattacctgccatttcctctaccacctgaggaatttgaacatctggagctatattagcattagcctcttgtgaatcaaaaactaaagatttaggccggtgcttggaagctgaggagttcctagtatttctgggagtggggataaaattctgttgtgacggaaggtcctctaacgactgtgaagtctttctaacatggcctctgtaggaagctctctggtcaacgtttgcgggaggcatcaattggttataaatgttagcgttattggtcttactagctctattcagggagcggccattagttctaatagcctctttgattttttctatttctttgaaaatctcaaatcttgtcccaaaagaatttatgtccaactcttttaaatgaacaagctctaattctaacaaaattttacccgatattttgtgcttctggaatctagaggcagattggacatcgtatccttccataataaaataagctgttatttcttcgggtgaccaaaactctgcttctacagggttcaatttagtagtatcaattccattaattaaagtagcttgattttccaaatctccgttcaggaacccagtagaactactcgttgttggcttactgttagattcgactacatccagtccatcagtggctgatagaattgtttcatgcgtaatgctatgttcctcgtctctgcccgaattgatgaaacgatctggtggacctatagagtcgtctttaaactccagtagtgcattgtctatgtcactcattgtattctttaaagacaagtttctttcgatctttccattggcagttctcgaaatagaggcggcggtttcaattggttgcggggttggcagttcactgtttgaatcgttttcactgataaaagtgctggaaagaagaggatcttcattggttaatggactatatatccttttggtagacttggctctcatcaatgtcggagccttctccactgttatcttttgagtaaagaccaccggatataaaccttcctcattggttctcagatttcgaccaaaataccagccatccttgtattcttcgtcatcagttattactttgatcttgtcaccgggcttcatatctagttcatcttccattcgcttaaaatactcattaatggcaatatacattgggaaattgccaccgtcacgcccggttgcacttcctttgctgtcaaaatccggtgacaaagtgtccgatacgtctttatctctgctgacagttgtgttgagctgcgagagtgtgggtacttccctgtcattactcatctttatatgttcaaattttttgcggagaagttggtatgattcaataaatatgtggctaaaaatgaaaagttaaaactgaaaaagcagttacagtctttttgaccactctaaaaaaaagtgtaagcagaagggaattacgcaaatagtgttaaaagcaactttaatatctgttgtctttaaaaactgctaagttttatcgtggggctaactatcgcttaaaaggaaagagtaaatatggctagtctaacactaaatattaaaaccagcttttttcaacgcttctaaatagggagaccttactttcttgacgaatttgtcctcatcaatctgagcattttgaatagcggctgtgataagttttgtttttttttaaaaaaaaaaaagaaggtctccttcttcgttcataccgcatcgatctagaacgatgggaaaaaaaggcaccacgtgactagagaatcacctttttagcgaaatatttgtttactaccctatgcatcttgcgatgagaagctacatggaaaagggacctataatttagttatcttacaaagtttatttatggaattgtttctcctgtgtttaaaaatatagggatgaaaactcatcggctatactgtcatagacccgtgtggaggaggcagcgcaaccaagtacagcagactggtcacaactaaaccgagctagtggacttggaaagagggtagcttgctgacatgcacacctctccccgggttttggatggacaccatgttttatgccgtggagcgggcacctggtacctctcaaatctctgattcctgcaaaatttccgaaacgtagagtcacgggtcctgacaagcaaccatgctccagagtgattggtttccttgattttttttgctttttcaaaaatttcttaacgtgggttttcttcttcctacttggactcatcccctgaaggtaattctgctgcttatttgggtcacacgcgccctgtagcaacaattcaatcatcctgtcattaagtatatcttgaatatcattacatcttcttttcaataatatttctgctgtaaatgatgactttacattttgtgaacagttattggtatacagaggataaatccaatgtaaattggaggaagagtacgattgccatatattagaaacagccatatacaagtttgaacaaaatacaactcaaagtaaaatggtagctgcacgacaaaaagtaattccttgaattttatttatgttgtacctggtaaccttaatttttttttttcttttctttgtaataccttagctctggttatatgcttggtccccttaattgtttatgtacccactacacattaatattgaggggaggattaaatacatactctgccttgattagtgcctctttttcttttgtcctttttccttcatttatagccatttttgtgtagatggtccaaattcctcggagtgctttgtttaatcagaaaaagtatcaatgagcaggaagcaaaaaaaaaaaaggtaaaaatttacgattgtgctggggttaaagaactctcatctcctgatgaaaacccggctactccatagaatcttcttttgagtatgcctgtaaaacgtactttaataaagagaacactcggttattgacagctagctttttaccttcttcttgacttgctttttccttagaataattaacctcacatcctttaagtacactttacttctacaaagagcgcaatggccgaactgtctacatgttcttgagctattaaccatttgaaataagcatggacaacaaaagacgtgcccacataacgtcatgagggctgtctctggaggttcaaaacaaatcgggcagcgatagtccttggctgcaccatactctttgggtgcttctttggtttcctcctgaaagtcgtcatctgatatttgcaacacttgttgctcttcagcgtctaagtctatggcatctgcagttaaatcaacagtttgttccttactatttgttccaggtttcgttgtcggcggtgctgcgtcaagcatcggggaagcactcggagtgtttgctgtttgtgaaagaacgtccattgtgtgcaattcttcaacattattcgttaatgtgatattgttaccagaacttgcttctggctcttcggtatgcattgtttccctgtcatgattcccagaatcgttgttactggtgttatggtcgctacctggatcttcttcaagtgctctaaagagagataaatcatcatcaccatcttcctcagaagtattctcaagagctcgctctccaatgatttcgactacggcctctgggctgtcatggcggttatctgtgacgatattttgtgttctcgatacttcattttcttcctcctcatcgttctgcctgaccgactctagtcttacccttttgattcgtagattttcaccttctggattttggttatcaggtcttcttgccatacaaggtgtaattaatttactcgtttgttacttggccgcccctttatattgactcagtaggggaaaaagtactgttgatcgaagaaagaaagttgttcctactaatcttccgcatgctctaatatctgacatattatcccttctcttctgtaatttcctaaaatacaaatagatgtagaaaacagttctttctttccctgttgtatacatccgtacacttttgtgaacccaaacattttttgtttaatttgaaagatttttttctattaggagccgtctccttcaattctcggcaaagcgagggttcctctcatgcttactgttctcttccccaccggcagctgctgggaaccctccaacatgctgtgcacgggggagggacagtagctaactacctttcacttgggcgggaaactgaaactaatacggtgctgtcccggcttgcgcctctgagacttactggaaggaagcccacggtttcttttcagttggatggagagttataatcaagaagtatatagattttgaatattgattaagcgagtaatattgctatttcgaaataatcgagaaatcacgataataatacagcaaaaatgtcaggtaacggtgctcaaggtacaaaattcagaatttctgtatgttaaaaccgaaacaagtggaaatacccatttaaatcacacaagatgtcgtcaatcaacaaataaaaaagtatattcccgagactgaatgttacaattgagacaagcaatgttcaagaaatgtgggagtctatcaatgaatatagtggatagccaaaatggaagatgccaaatttatccttaatggcttctccatgcctacatccagatagcgaaatctacttctgggccttaaagcgttaaatggatgcctttccaactgattactgagaaggttacttttgttaagactattggaagttctatgcggaatatacaaactccaaaaatgtccaattgttgtaagatcatttatgtccaagaaatatatttgtgttgatggttccattcttgccaagataggattgatttactaacagattaattgtgtgctcatttttatgtgtcacttacattttttttaaatagttaggtttaccagttggtgctatcatgaactgtgctgacaacagtggtgccagaaacttgtacatcattgccgtcaaaggttctggttctagattgaacagattaccagccgcctctttaggtgacatggttatggccactgttaaaaagggtaagccagaattgagaaagaaggttatgccagctattgttgtccgtcaagctaagtcttggagaagaagagacggtgtctttttgtacttcgaggacaatgctggtgtcatcgctaatcctaagggtgaaatgaagggttctgccattactggtccagtcggtaaggaatgtgccgacttatggccaagagttgcttccaactctggtgttgttgtttaaataaaatttccaagaaaaattcttttaaatcattatgtaaccttttaaaatattaatataaacaatccaagtcaagtcaatgacatgagagtgcatatatacattgttggagaatatttcagtgaagcggttgcctttttctttgtgaacatcctagagtaaacataatacataagaatgatttttcctacaattacagaactatattcttcaaaacattactgtagagggtcataaagataggtttctttatttttttcctttgactcgagaatccatgctataagattgttaatcattaacgatgcatttcttctggaccatcgattagttgaacataattgcttggaataatacctgtttcaccgtttgcccttcttgccttccaccatctgccttcaatgtcagagacttgtaggatttcattttgttcaaatgagatttcgtaagcatcatcgtcatcagcgtcgtatgggtacagtgcttttgccttgtaaatgaaattatcatcaccgatatcgctatacagacccaaagtgtctcccatcgtagtttccgtattgccatttgaaaaatcagtatcgaacgtattacctatattagtattggtttgattattgctattatcattggtttccttcgcgttgcttgcgctattgatacgttgttgtagagtgttcaagtgaagattaacggcttctgaagtatttggctgagtattctcaaaaccagccaatgccgtagaagatacataatttgtgtgagaaggttgctgctgtggatatccatcaaactgtgtcgcgtagcctgagtctcgtatagcatcattatagacattattttggtaaggcgttgtgttcctattgcctcttcgacgagctctatgaagagaattctctaatggcgaaggcctgatacccttaatggaaaacgaatcaatccatctattggttggggaagcattatcaccgccgtagtacagaatccagattaaatttatgatggaaagtaagatgacacctgctgaagcagcagctttcttgggaccatccgcatacactaaattcgttgcactgtttgtattatacacaaatgccactgcaatagatgtggtgatgaagattctgtaatgatcgactaaatcaaaacaatagaacagcattaaagaacaaataattagaaattggtatactataccccaccaagtaaaacgtgggaaggattcattggtggatgcagatgagatggagcccccgatggcgatgacccacgatacaattgccaaagaaattgatgatatagcgaaaggatcggcataaaattttttcattttaaaagaatggtcggtagccatacgtgaaggtttacgaggagttggtcttatctttgatgatattgacatattttgaaaacgtgatttttggtgtttctgaaaagatggcgttgatctataatgtccaatgttgttttcaaattattgggttggctactgttaataacacgccctttcttttagcgattctgttgagcaaagaaagctgatatgatagacaatgatacctcactgaaaacgaggctcaatgactttattcgtgttcctgtgttctttgcatatttcagcaatcgctgaaatttttataatacgtatgaagcaaaagcccgactccgaaagctgttgtgtgtaaatagattgaacgcgttgggaatgtaaaacgcgattaagaatttctgatttaacgcaggtgctaggttattaatagtttcttacgcggatatgtaggttcaagggtctatgtacgtatggaggaatagcaaaaaaagaatgagtatactcttgcttatttagtttagcttcaaagctgcggtcaggcaggtgatcatgattattagcccccagataaacaagagaagacctgtgtatttgaaaatctttgtcgtcaatggcacggctgtcttgtgctcagttcctataagcttgtagccaaagagcccgggcagaatgaaagaaatagaagtggagcctgtggccccaacaatggccagtacacgggccaaggaggaaaccgaaatggcgacaagatatgatgcaactaaaatgctgcacgttataacaataaagctcttgcctctcaatggagtctccttaggctgataaatagattcttcttcaattacctcattgaggtcaaggctactgtcgcgaatcaacggagaactttcggtagcaacagtgggttcatccgccgatgtagcacttatacttacattttcctcggcgaagtgttgcaaaatctgatggattgaagctcttgcaggatgacactgtagtgggaacgccagcatcaccaacaacacaatcgctattctgccgatggtgctcgagaccgcttgcgggtacagcatgataatgtttccaatgatgttgtcgccgaatgtcaggtatccagcacagccgatcgcaatatataagatgagagccaaagatattgctatcagtggaatcttcatcacatgctcgaaccggcttgacctctgctcattgattattgaaaacatattgtggtgacatgtgtaggcaaagacaaaaattggaagagtgtttagcacgttcaaatcatgcgattgtggtggcaggaggtaggagatccggcctttcaagcgaagaatctcatctgatggtgctacatagtgcaacaacaccaaaacacacaagtacgctacagaagagatggccaccatggaagcgtacctcaacgaattcaacttcttcagaaaagacagcggggccacgaaaaaaagcatgatcagtgaaatttgcacgttcctgttcaacagccaagcatttctggtccacacagacattatttggggcatcagatccccaactacaatcatataagagacgcccacaccaaaacacttgatagcgatcgctaggtcaaacacaatacctagatttgggttaatcaaccgcgtcagagcactgaacgaggccctcccctgtggtacgtatttagctacacgagcttgtatgaacaagctttgcatagcgcacgccccacacagcactatcattatcactccaggaattaatccaaacggcttgaatgcgtacggcatggccaggataccagcaccgcacgccgtgtgtaaaagtgtcagcacacctgatctaatactagctaccatatgatgcacgattcctttctatggttattgagctgtgaaactaacccgtcgttcgaccattgttgttctatatacttctagttgctgtatagataagctctccgatcccctaaacgtgcgtggtgatcttactctttcgccctcgctttttttttttcgcttgttgttttcgcaaggtgaatagaatggttttagtagcaaagtgcattgtttattgtgtggtgtggtttgacgcacattctgtgttaatagtgtagcagaagggtattctacaatctccgcgaacctaagtatgtctgctgttgaaatttcccctgacgtgttggtgtataagtctccattaacggagcaatcgacagaatacgctagtatttccaacaattcagaccaaaccattgcatttaaggtcaagaccacagccccaaagttttactgcgtgagaccaaacgccgcagttgttgctccaggtgaaacaatccaggttcaagttatcttcctgggtttgactgaagagcctgccgcagactttaagtgccgtgacaagttcctggttatcacgttgccttctccttacgacctcaatggcaaggctgttgcagatgtttggtccgacttggaggctgagttcaagcaacaggctatctctaaaaagataaaagtcaaatatttgataagtccagatgtacacccagcacagaaccaaaatatacaggaaaacaaggaaactgttgaaccagtagtccaagacagtgagccaaaggaagtgcctgctgtggtaaacgaaaaggaggtccctgctgaaccggaaactcaacctcccgtccaagtaaagaaagaagaggtcccacctgtcgttcagaaaaccgttcctcatgaaaatgagaagcaaacgtccaacagcactccggccccacagaaccagataaaggaagccgcaaccgtacctgcagaaaatgaatcatccagcatgggtatattcatattggttgcactccttatcttggttttaggatggttctacagataatagggagattgaggatatagctgtattctaaatatatatttatatatgtgtgtgttttgccctttccttcctttcagtctttattttactttgtttttctacaatctttttttattgtttccttctgtagcctttacaatactagaacaaggaactaaaagatcatactttcctaacttttttatatgttttattttttaaataggagaataatcgataactataccactgttgtaacatattacttgtttaatttattcatgttcggtttccctagtgtagtaggcgctatcttgggcaaataactatccgttattaaccataacaatgcggggtctactaaatgaggggagggtcttggatgcacattaacgaagatcttgcgagggggtcgcgcctaaaaggtccataaataaatgaatacataaacagccacctactttcagtttgttttttgctaggtctcatagtgaacgagggactcacatattgacaatatagtaacatgggcttatcgcgctggcacgacaagaattcaaggccagcagaggaaaagagcgaagaaatgcaacaggatgcgcactactacgcccttgcggcaagtgatagtttaaatgcaagtgtttctaacgaatatggtaatcaagtaatgaactcgttttggaaagtgggtatagactctccctatgtggacgatgaagcaattagaaacagagatgtcgaaaataacttaccttctttaaagcaaagtgtttataatgctaatgaaccaaatgctacctcgtctgcattttcaaccgcttcatacgcacatgaaactttcgattttagaaaccttaaactaagataaggggggatgaagaataagaataaacgcacgtacaatgcatatacaaccgtttctatgtaccataaatataattatcatataatgaaaaatgagaataaaaaacaatgataacaatgaaaaaaaaaaaattcaattaaagagaaaattaaacttattttcttaagtagtcccttaaataactaccgagtttttcagcaccctgttctacaacgtctctcaacatctgcaattcatcatctgcggaggcattaaaatcgatgaaaccgttattagaattacggccatcaaaattccctgctccacttccactactattgatgggattaccaaattcatccacttctttatcttctccaaagtatgaagaagaggaaattgatgtagcattgtcaaatgttttcaacttgtcatgcgcttccctgtttgctgcttcatcaaatgagccacgaccaaataattgatcagatgatatagctttttgtgtgccgtacctttccgcgattctgcccgtatatcttggtccctgagctattttctgagattctttttgttgctttgccaaatcattggcgtcattcatggtcataccaaatcccaatttggcaaacttgggtgttaaagtatcttgctgttcttttctagttgtgtcgaagctgtttgaagtgtcatttaaaaaatcattgaattcatcaggctgggtattaatatcatctatactgttattattgttgcctttactgttattcataaattgggaatcgtaatcattttgtctaattttggtgctagaagacgaattagtgaactcgtcctccttttcttgttgagcctcttttttaaattgatcaaacaagtcttctgcctgtgatttgtcgactttctttgcggttagtctagtgggctttcttgacgaagacaaaattgaatgtttctttttatcttgcgagtttaataccggtttctttctgctagccgttaagatggaacttctcgttttagtgacagtggtcttgggtgtgctgcctgtggtgttgttttttggggcgagagagcctgtatttacattgagtttagaactggaattggagcttggtttttgccaattagagaaaaaatcgtcaacactattttctttggaagtcgacctggaagcgtctgaatcggtgtccaacggtgagtccgaagaatcttgaccgttcaagactaattctgatgggtataactccatatccttttgaaccttcttgtcgagatgtatcttatatttcttagcaacagggctcgtatattttgttttcgcgtcaacatttgctgtatttagtagctgtttcccattgttctttaagaaaaaatcacgagccttatggttcccacccaacttaaaccttcttaaattgttaattgtccatttatctaatgtagaagactttacaaaggtgatatgaacacccatgtttctatgcacagcagagcattgaatacacagcatcacaccaaaaggtaccgaagtccaagtaggattcttgttaccacaatcaaaacaaactcgattttccatgttgctacctagcttctgaaaaacttgttgagtagtctgttccgtggcaaatgtttctccttcatcgttactcattgtcgctatgtgtatactaaattgctcaagaagaccggatcaacaagtacttaacaaataccctttctttgctatcgccttgatctccttttataaaatgccagctaaatcgtgtttacgaagaatagttgttttcttttttttttttttttttcgaaactttaccgtgtcgtcgaaaatgaccaaacgatgttacttttccttttgtgtcatagataataccaatattgaaagtaaaattttaaacattctataggtgaattgaaaagggcagcttagagagtaacaggggaacagcattcgtaacatctaggtactggtattatttgctgttttttaaaaaagaaggaaatccgttttgcaagaattgtctgctatttaagggtatacgtgctacggtccactaatcaaaagtggtatctcattctgaagaaaaagtgtaaaaggacgataaggaaagatgtcccaacgatcttcacaacacattgtaggtattcattatgctgtaggacctaagattggcgaagggtctttcggagtaatatttgagggagagaacattcttcattcttgtcaagcgcagaccggtagcaagagggactctagtataataatggcgaacgagccagtcgcaattaaattcgaaccgcgacattcggacgcaccccagttgcgtgacgaatttagagcctataggatattgaatggctgcgttggaattccccatgcttattattttggtcaagaaggtatgcacaacatcttgattatcgatttactagggccatcattggaagatctctttgagtggtgtggtagaaaattttcagtgaaaacaacctgtatggttgccaagcaaatgattgatagagttagagcaattcatgatcacgacttaatctatcgcgatattaaacccgataactttttaatttctcaatatcaaagaatttcacctgaaggaaaagtcattaaatcatgtgcctcctcttctaataatgatcccaatttaatatacatggttgactttggtatggcaaaacaatatagagatccaagaacgaaacaacatataccataccgtgaacgaaaatcattgagcggtaccgccagatatatgtctattaatactcattttggaagagaacagtcacgtagggatgatttagaatcgctaggtcacgtttttttttatttcttgaggggatccttgccatggcaaggtttgaaagcaccaaacaacaaactgaagtatgaaaagattggtatgactaaacagaaattgaatcctgatgatcttttattgaataatgctattccttatcagtttgccacatatttaaaatatgcacgttccttgaagttcgacgaagatccggattatgactatttaatctcgttaatggatgacgctttgagattaaacgacttaaaggatgatggacactatgactggatggatttgaatggtggtaaaggctggaatatcaagattaatagaagagctaacttgcatggttacggaaatccaaatccaagagtcaatggcaatactgcaagaaacaatgtgaatacgaattcaaagacacgaaatacaacgccagttgcgacacctaagcaacaagctcaaaacagttataacaaggacaattcgaaatccagaatttcttcgaacccgcagagctttactaaacaacaacacgtcttgaaaaaaatcgaacccaatagtaaatatattcctgaaacacattcaaatcttcaacggccaattaaaagtcaaagtcaaacgtacgactccatcagtcatacacaaaattcaccatttgtaccatattcaagttctaaagctaaccctaaaagaagtaataatgagcacaacttaccaaaccactacacaaaccttgcaaataagaatatcaattatcaaagtcaacgaaattacgaacaagaaaatgatgcttattctgatgacgagaatgatacattttgttctaaaatatacaaatattgttgttgctgtttttgttgctgttggataaagcgatttttatacttttctctttttcctttttttttttgattggctgtttccttatgccgctctttcccaatttatgactttccaataatgtattattttgtttctctttctctctgttaccctttattttatcatctacaataattgaattccggagagggtaaagaaacaggaaaaagaagaaaatgagacatagtcagcatcgtaatcgttttccttctgtatattcctttatcaaaagactacacgcacatatatattaatcccggtatgtttttggtgtgctaaatctatcttcaagcactattatagcatttttttaagaatatccaaaataatatgtaatttatgattaatcaaggttcaagaattggagaaaccgtgagcgacttctttgatacttggatgtaagcttttatttagttgctttttcgttttcttttatttacgcccttgttttgcgtgtatactttacttttctaattcacttgagagcgggactatatataaaaaaatgcacaattacaaacttgagaatgaatgcatatcgtgaagattttgatattaaattaagaagccaaaaaaacgtaggcaaccataacaaatttcggcattgaacttgattctaaatgctacatacaattacgcgcgctgttttgatatacacacacatatatatatatatacattgtgtaagaaaaattcaaagcttagtaaaacatacagatcatggagaaaaaaaaaaaaccgaatacttgtgttaccagaaggatccactgactggacttgggtcacaatttgaattttattgattttcaccttcatcaaggaggatggtcgttagtaataaagggcattctgagtgacagacaaagaaattatcttcaaagaaatgttactttgattcattgatatgttatttgtttttatttgaaagcactcaaggaaactagacaacagtagtatcaatagtagatccacttaaatgcacatcatttacagaatacatcctctttgtgaagacgatatcctcttggtcatcattcaatctaccttcgctaacagtatttgctgaagaacaatcccaattaccagaatttgagaacatatcatcagatgtttctgtcatactatggtcactctcattggataatgataacatagaagaatcagatattccactcttcccagtaccattaccatcgattattttaccggtatcgacattgaattgaacttgacaaatttgatgtaatcccagttcacaaaaattgtcaagagttactaaacttccatcgtttgccatatcaaggaataaaaatccacatccttttccattggccttagtgtcattgctcttcaagcaaatatttttatcactcataccactcacaataatgtttccacattggaagacttgcttggttaatagtagttcactttcactatctaggctaattgagttaaatccatggactaactcaccatatttcatgttttgtaggttttgtaaatcccaacaaatgacaaagccttggtcatcactgctatataacgcgcctgtgttttcgttaaattttagactttcaatgtatcctttcttagcatataattcacaaactggtttaccgtcgcaggattgaatgtcccaaatttgaattttatcgttcaagctctgtgcaacgtgatgattacttatccatacgcaatccaaacttgtgttctttctttgcaaatggtcttttccacatcctgcagatatgctattatctaaaatatctggaatatagagatttgttctcaaatcaagcagcgagatgccatttggtccaaattttgagccaactaaggccagtaagaagggatcatggaattcattaacggcaaaagaatttatacctggatatgattgcaaaaaaataggtgtttttatgcaatcaagatttgatttcaagtcatatataaagagggagtcatttagaagggaaacaaaaccggtcttgttccatggcgaaaccttcaaaataggtgctgtttttggcgttatttccagaatcggaatcgacgttgatacggtagattttagaaacttgttgtggttaaacctttttattattttagcacatcccttatatgttgaagttgctatcagattgactataccgtcttgatgacctgtcaatattaattggttgtggttaggatttatttgagagctggggaaaatctgtggcggaaaatctaccatgggcaataagcagatacaagtaatgggtttaccgggaacagtaatcgtctgtagttccttcagctttttctcagcggaaatttcaaaaagtttcaagttgtctttctcgttcattgtagatactagaagtatattatccacaatggacatgtctgaaggtatggataactcactttcatcaacaccgtacagtttccaataatctgattttaattttttagttgtataatagtcattgaagttgtctgatgcttttcgcaaaatcggtgaattcattttcgaagtattgttttgccacgtttttttgtatgtggataaagtcatcatcgattgtaaaatcctctttttatctgatctcttctttatattaatagcaggctgacgaaaaatatttgttggttcgtagtatttggtatcttgcataatattaatacgtgtcactctcactatcacacctacaatcaaattttttagcaaacacagattaaaatttggaagtcatgcaagaagaagaagccaaaagatagtttgaggaaagcttgggagagatatttctacctttttatatattgtaaaacgtttacgcacttatttatgtaaaccagtaagcacccacccagctatgtcgtcatgactacaaattggttatgaaccaagccttattcagtaaaccagcaaatttaacatcatgccggcattgaatcatacatagaaatcaacacaatagctttgagaactgagaatgtagctttgacgctgctattattatttggtattgtttaccttttaatgtttatttgtttagaaaacagactgctggtttgtttacatttgagagcagaaaaaaaaaattgctggcgcagaccagccgcacagtcacgtgacagtatacgatcatgtgatcttacgtacataatgacattatacgagaaaggggaaaaaacaaaaatttagtggaaatttttggtaaagaccaaattgcagtgatcttcatggtgaaaggtaatattttttgctggcgggggagggggcttctatctcgacaattaaaagacatacgcttaaccatttttagggtactcgagtatcgcatctgctaattgataaaaggactttgttgtgttttgaggctgttttccattttcttcgttagagctacaagagtcgactttttcgttaaacaaaaacgattataagataataagcgctgtcagttttttccacagttttggacttgttactataattcgtgaagcacattttgcaagtgagtcaaaatttcagttcagtccttctttagaagagtgagtgcgtagcaaataaaacagcaggaaataattgcttgtttttgtgtgtaagtaccttttagttggaactaccgaatatagtgttattcgactttcactttcataagccacagctttttcttagtgcgtttttagttcgataaatttaccaaaaactattttccccttttcttattcccttttctttgttagcttgggtattatatttaaagtaacagaaaggaaagaaaaaagaaaaaaaatgccttcatccatatccgtcaagttagtggctgcagagtcattatataagagggacgtattccgttccccggatccgtttgctgttctgactattgatggttaccaaaccaaatctacatccgcagcgaagaaaacgttaaatccctactggaatgagactttcaaattcgacgatatcaatgaaaattctattttaaccatccaagtctttgatcaaaagaaatttaaaaagaaggatcaagggtttcttggcgtggttaacgtccgcgtgggtgatgttttgggccatttggatgaagatactgctacatcgagtggtagacctcgcgaagaaactattactcgtgatttaaaaaaatctaatgacggaatggccgtcagcggtaggttgattgttgttttatcaaaactaccttcgtcaagtccgcattcacaagctccttctggccatactgcatcttctagtacgaatacaagttcaactactcgaacaaatggtcattctacttcctccacccgtaatcattcaacgtctcatccttccagaggcaccgcgcaagcagtagaatcaactcttcaaagcggtacaacagctgctactaatacggcaacaaccagtcaccgttccaccaattccacatccagtgctaccagacaatactcttcgtttgaagaccagtatggtcgtttaccccctggttgggagagaaggaccgataactttggtcgtacatattacgtcgatcataacacaaggactaccacttggaaacgtccaacgctcgatcaaacagaagccgaacgtggcaaccaattaaatgcaaatactgagttagagagaaggcagcataggggaagaactttacctggtggatcatcagataattcctctgtaacagttcaagtgggaggtggttccaatatacctcctgttaatggtgcagcagcagcagcgtttgcagctacaggtggtaccacatctggtttaggcgaattaccttcaggctgggagcagcgatttactccagaaggaagagcttatttcgttgaccataatactagaacaaccacttgggtggatccaaggagacaacagtatatacgtacttatggccctacaaataccaccattcagcaacaaccggtctcccaattaggtcctttgccttctggatgggaaatgagattgaccaatacggcacgtgtatatttcgttgaccacaatacaaaaacaacgacctgggatgacccaagacttccatcatcgctagaccaaaatgttccacaatacaagcgtgacttcagacgtaaggttatttatttcaggtcccagcccgctcttagaatattgccgggacaatgtcatattaaagtacgtagaaagaacatttttgaggatgcttatcaagaaattatgagacaaaccccagaagatttaaagaaaagattaatgatcaagtttgatggtgaggaaggtttagattacggtggtgtttccagagaatttttctttttattatcacatgagatgtttaatccattttattgtttgtttgaatattctgcgtatgacaactataccattcaaataaatcctaacagtggcatcaaccccgaacatttgaactatttcaaattcattggtagagttgtgggtcttggtgttttccatagaagatttttggatgcattctttgtaggtgcactttacaaaatgatgctacgtaaaaaagtcgtattgcaagatatggaaggtgttgacgcagaggtgtataactcattaaactggatgcttgagaatagtatagatggtgtcttggatctgacgttcagtgccgacgatgaaagattcggtgaagttgtaacagtggatttgaagccagatgggagaaatattgaagttactgatggtaataagaaagaatatgtcgaattatatacccaatggagaattgttgatagagttcaagaacaatttaaggcattcatggatggttttaacgaattaatccccgaagacttagtaactgtgtttgatgagcgtgaactagaactattgatcggtggtattgcggaaattgacattgaagattggaagaaacacactgattatcgtggttaccaagagtcagacgaggtcattcaatggttttggaagtgtgtcagtgaatgggataatgaacaaagagcccgtttattgcagttcaccactggtacttctcgtatacctgtcaacgggtttaaagatttgcaaggctctgatggtccaagaagattcactattgaaaaagctggtgaagtacaacaattgccaaaatctcacacatgttttaacagagttgatttgccacaatacgttgattatgacagcatgaaacagaagctaacattggccgtggaagaaaccatagggtttggtcaagaatgattattccgcaccaattttttttttatttatggtgtccgttttcccaacattctttctgcctcaatcatcttgttttatatttcagctaacaatagtaaagagaaaactcttttttgttaattttatctgagttgctcatgaaatgattaatcattgttgtttttacagcaacatggaaagcagcaaagaaaatgcaggaaaacgtgaagtgctttttttgatgattacgcaaagttcttttcaagttcgccataagaggaggttttccttttcaaaaggagcatgataccaataatttatattgccttacgcctcttattttttatatcctctttttagattttattaatttttttttttatttatatacatataatgtgccctgctttttacaaccatacgttttttgttttttaattttcttgcattttaaaactgaatagtgacctgggtattatactacagttgaaattgctctcgtgaggtacatacttgaaacgagcgtactaggcaatccctctcttgccagtcacctacacacggagagtatcggttatttgtcgtgaggaaaaaagaaccggataataaattcttgatttgttatattgtacagagaatgacgagaagtaaaaagagaaacccgaacaggacagagcgtacattttttatatacctgttcttttgtgcttgtagacgtatatcgtattattaaattaaaagtaaacctaatttgaaccatcgagataaaaaaaaaaaaaacggagcacttttttgctcatacaagcaaaaccgcattgacacagccgtctctgtctggttcgtttgtgacctgagcatacttaccccagacaactttaccaccagcagtaaccatccccaattccgaaacgttaacttcaataatggtacctttagtcaaaacacctaactgagtgtacattggagattgtggattcttcttaactgccaaaattggcaagaagacagttacacctaattccggatgagtgacgtttgcctttttctgtctcaacgcacttggtctgatgattctttccattttaactggtcttctagtgaaaccttcacccacaaaagtgtgtttcgttatcattctcttccatgacttggatctagatttacctgttttaataactttgaacatttcttcttcacttataccacgaacctttggtaacggaactgaaaacttatcagctttttccaacctcttttgtttgatcgatgaagaaatagctttggctgtgttattttgttctctgtccaatagatatgtcggcaaagcatcaccatcggtatccaatggtttggatgaacccttgaccttagattgttcatgtgccttaatcttctttctcattgataccttttcagcatatctcttcttagcaaattgcttacccttccaaccagtcaacttctgggcccgttcagaaatcttatgagactctcttgcctctctcttacgtttcctttcttcgtgatctaatcttttaccatgctgtttgatgtgacgctcgatataatcgttttgaggcattgtttcgttgtatatatcagtattgatacgagactgactactgactaaagataaaaacgccagatacgaaaaccaagttcttctctaactgatacctaatccattcaattgtcttaaaagtgcatctcatcgctgtccggaaaatttttcatcggattgttactagaaccgttgccgacgacataaaattttttacgcctttcctgcaaggttgaagaaaagaaaccgatgagctataccattctaaagtgtcaaaagagatgaagaaattaaaattgtcaactaacacacaaatccaagaatgtctgaacttaatgcattattaaaagatatcaacggctcgctcactgcgacatcagaatccttggagaggttgtctgggatttatagtaattctgcgaccgatgagattcctgaaagtaaccaactacatgagcatctattttacgacgctaagaagcctgctgagaaagtatcgctgctatccttaaaaaatgggagcatgctagggtacataaattctctattgatgcttataggcaataggctagacgacgagtgcaaagatccttctgctatggatgcacgtgaacgctctattcaacaccgtgtggtattagagcgtggtgttaaaccactagaaaaaaagttggcttaccaattggacaagctgactagagcatatgtgaaaatggaaaaggaatataaagacgctgagaagcgtgcactggaaaaatctaccttagtgaatcatagcggcaacgacgatagcgaagatgatgagtctagtgaggatgaaatagcatacaggccaaatacctctggaattatcaacacaaataaaaaatcatcagcatacagggtggaggaaacggctaagcaagaaaacggggaagaaaacgatgacaatgagactggcgtgtataaaccaccaaagattacggctgttctaccaccgcaacaaacgcattttgaagatagattcgatgccagagaacacaaagatcgtagtaacaaatcgcgtatgcaagccatggaagaatatattagagagtcatcggaccaaccggactggagtgcatctattggtgctgacattgtgaaccatggaagaggcggtatcaaatctttgagagacacagagaaggaacgtagagtcacttcattcgaagaagataattttaccagattgaatattacaaataaagctgaaaaaaggaagcaaaagcaacgagaaagaaatgcaaggatgaacgttatcggtggtgaagattttggtatattcagctcaaagaggaagctggaagatagcacttcgagacgtggggccaagaagactcgttctgcctgggatagagctcaaaggagactgtagatacaaaaagtttattttcttatatcctaaagcgtttatagacttaatatttaaaagttaaatataaatgaagggcactggtatataagctattaaaaacaagaattttggctttcacgacattaacgtgtgagaggtttaggcaccattgcctttatgattattagtccctccagaataaactctacctttttttttcttttttttttttatagtcctaagcagaacatgactaaatcgccataaattaacaatatagtgggaataaggcacaccagaagtgccacgatatagtatatatacaatgataaatgagtacgttgccagaaaggtcgctctaaaggacatgcaaccatgtgcgatctgtagcaaaccatccactaccgtcctttacaacgcatctggtccagattggctatatacatgcgaaatacatttacaagataatccacaatttgtcattcccctctatagtacagagtataatgaagccgtggctcaattaaaactagtaaaggggaaaatggatagtctgacatcagctcaaacccaattagggtcctgggatggttgggttactaaaatattctccaagaaagaaaaggagacaaataactctaaagaccctgatccaactacaaccgactctactgatacatctccacaggctaagaacgatgcagaaatcttgtcagaaacaaagaaacagtacagcaaaatacttgacaaagttacagaactgcaaaggaaaaacagaaaatacgaactagcaaaaatcatgtttgaaagcagactcctaagaaaaagaacagaacaagtaaatcgcgaacgatacctcaaggagcaagagaattactctaatacggatcctgaagaactgcttcgaaaacacgtgttcccctccgttccaaaataaggacgcaacggttggaccgttcctcttcctatggcctaatacccatgaactattgattatatagtatataaaactcaccatggattatctattcatggttcgtaaccaaaagctaaatgctcatcacattctaaagatcacaaaataaaatcaacacgtatcaagcgactaaattgtagctaatttttttctttctttccagggaaggcagaaagtgtgagtgatgtttgtatttctgacaagctgttgagagcaggcaaatggtgcttcatcaagttaaataatcatcgttgaacgacttcaaattaacagcggcttgttccttcgttcccttcatattcatcactgagcgtagaaagctaacgtattactcttttttttggaaagggagtcaattgacgcttaaagactagtcattttgtttagaaaaagtcttatatttatttctgcaggtggcaacatactagcatatggaaaaagtttaggtaacgaattttgatcaaactaaatctcacttctgaactgactacatattctttatttaaggagttgacatttttcatttatccagtcacaattttaaaagcacttcgttaacacgtttggttgtccttatttttgcattgtgattatatcaggcggcattaagtgaagtataccttgtgacctgaagatttactttggaaagtaattgatgttttaagacagtaccggtttcctttttttttatttggattttttgtcagtaagaatttgtaattatagattaagataaaacgaaaagaagcatattaataaggagttttgaacatggataggagtgataaaaaagttaacgtcgaagaggtcaatgtaccttcaaacttacaaatagaattagaaaaatcaggcaccagtagcagtgtatcactccgaagcccgactaagagtagcgctaccaatttggcgggcatggccgaaggtgcaagagataatgcatcaatagcgtcttcatcggtagattccctcaacatgctattagagcggcaaagagtaaggcagttaaaccatccacagcaccaacagcatataagtagttcactagctaagaccccgacaacgacttcatcattttgttcgagcgggagttctaagaataaagttaaggaaactaatcgaatatctctaacatacgacccggtgtcaaagaggaaagttttaaacacttatgagatcatcaaagaattaggccatggacaacatggaaaagtaaaattagcaagagatatattgagtaagcaattagtagcgattaaaatagtggatagacatgaaaagaaacagaggaagtttttcacgtttatcaaatcaagtaaaatatccgaaaatgataaaataaaacgagaaattgccattatgaaaaaatgccatcacaaacatgtcgtacaactgatagaagttctggatgatttaaaatcaagaaaaatttatttagttctagagtattgttctcgaggcgaggtaaaatggtgtccaccggattgtatggaatcagatgctaagggtccctctttactaagttttcaagaaacgcgagagattttaagaggcgttgtgctcggcttagaatatctccattaccaaggaatcattcaccgagatattaagcctgccaacttattaatatcaggagatggcactgttaagatttccgattttggtgtttctttagctgctagcagcacgaatagttccgatagtagcgaatccttagacgagttagaattagccaaaacagtgggcacgcctgcattttttgctcccgaaatgtgcttgggtgaagatgcattcaccaggtataacttaacaaaggaaaatttatttcgtggttcttgcatctcattcatgatagatatttgggctgtgggtgtgaccttgtactgtcttctttttggaatgctgccttttttttctgattttgagctcaaattatttgaaaaaattgtaaacgacccgttaaaatttccaacatttaaagaaatacagtccaacaaagtatctaaagtatcttgtgaggaggaatacgaaatggcaaaggaccttttattgaaattgttagaaaaaaatccccaaaaaagaatgactatacctgccattaaaaaacatccttttgtttcatgggattttgaccacgtaccggagaacgatgaaaagttactatcttctgtccttgagcaaaaattacgtttccaatgtaaccaaactgatcaatttgaacccatttctatttcaaagcacgaattgaaaaacgctgtctccggtgtcgggaaaaaaatcaaagagtccgtactaaaaagtatcccgctaaaggatccgtcagatctctctaataaaaactaccttcatccaacggaaaccactaggggcagaggggatgccaatgttattgtcagcgaaggttcagtgttatcgaatattaaggaattaagtgctaatgatggatgtttgaacactgatagcgacactaatattaatatcaacgacgatgatcattatagtggtgatgataacgatggacatttaacgaaaagagaactagaacgagaattaaacaaattcgatgataaacacgaggccggaaatatggttaatttacctatcaattcctcatttgcatccttggacagcttctacatagataattttgcgatggctagaatgggaatgagttctccagaagcgggagattcggtttcgtctgtaccaaaccttccttctgcaccgtcttcaacaaggcttggacgatcaccagtctttagtggagtcaccaaccaaccaagtccaattcgccccgttttgccacaacaaaagtcatcgttttgtgcaacaggtcggtatgataagagtcacaatagtcttcttagaaattcttcatctcatctaacgtcatacaactccggcagaccatcttcaaggactggccgaatgaattcacgcaaccaaaacttaccgaaaataccaaatagcctttcaaaaatctcaacaacgaaattgactgaactaagagttccaaaggattcagaaattccatcacctgcaaaaaaccctaacgctgatcgtttgagaaggtttcccgtaaagaaaaataccaaaacacccgccataaaagatcctccgagaataaacattaatagcagcgataagtcaggctccaaaaattctcctataaaatccttataccaacggatgaaacagtctaaggataattcaaaaaccttcgaggtacgtagaggaaactttttcagtcattttaatggagatgatgatgatagcagtagccagtcgtccgtaaccagttctggttcagaatctgattctgaattatcatccacttcatcgtcctgtacatctggaacccaatctcggaatagctccaacaataatgcatattcagaaacggagtcattacctttcgagtttggtgttgattcagaagatggaagtggagtattattaagagatttacctaacgaagatcaaataaggccgtttctggatatacaaccatgtcgacgcatgaaagttaaaagttcattgaacctcgaaccaccttctgtctcatcttcttcatcttcatcctccgacgaagatgagctaattttaaatgtcgggactgcaggtcatcgaagaaggcataattcttcaaaacttagtgaactatccaatagtccgcagaagggatcaaataatttcatgtattccaatggaagtgttcatgacagtgagacgacgataacgccgcaaaatatggatgacttgacgctgcatcaggcactgagccgcagccaacccattagtaagcctggcccattagtattaccaaagcgtttagaccaaaagaaagctacgacggaaacctcaaatttaacagatatcgttgaatttaacggtaataacgatcatcgaaaggacaaaaatttcgataaagttctttattcaagggacttgttaaaagatgctctaagttccactaatgcaggcagaaggagatccataccttcaaataaaataagaggacgaaaggacgcaagtattaccatgagtactaatgttggtaatgatgaacatgctagaaataccagctgccatggtgataaaggacaagaaaatggcgctataaaacaaaggacccatgaaagatcgcgatctttaacagtcgctgaactaaatgaagagaagagaaggagtgcacttccatgagtgtaaaattcaaagtaatttccatcggactacgatgttaatcagatatatggtagaaagctctaactttttacccttgccaacatgcacgcatatatgtgtatgttaaaataagttctgtatttgaaatgcatgtgatttacaatcctcttgcaatgaacttaatatcattaacaggctaaaaataatatatgatgtagatctttttagtttagcataatataatctataaatctataatatttttattctaaattattaaaagggcggcgagagaagtgtatctgtgcttagaaaacttttcgtttcttcgtctcaccctgagaagtgccttttcgtttcaaaatcattactggtgagtgtcattaaactttttcaatttgcaatttccgtatctttaaaatttcataaggaagcgtgagttttaacgtgctgattcaaattaatcgcttctgctgaagttcttattacagatatggcatgtaaatggtttttcgcacatatgtaaagatctgacatgcctcttcaaatgctcttgtcttttaaatcttctatcgcaaaattcacaaccaaattgcttggaagcgtccggaattaaagagggcttccttccgcgcgtcttctgcatgcttcctgtcttcttcctcaccactaagccatgagaagaagaggaagattgtactgaaggtgatggtgcagaaggagaaggagaagaggatggttctgatatggcagccaataagtcctttctcgaatcattgctgaattttgaaactggctcaatcatcttaaaatcactgccagacttaaatggattcgttgtcttagcaatgctttgagtagagatatccttgttatttcccaccagctttaacggatttattatcgcgtggtcactctcatcactttcttcattagaggaaacatcaaaccctgaatttataagcacttcattttcttgctcaagaggaagagacttgattagagtgcttttcctacttctgaagaatctatttttgaacattttctgcgaggaagagttttcggtctgaatgggttcacaaccaaggctattactgttattattactactgctactactgccgaatatgtttaatttgaaatagtccctaactttttttttagattggggcacagtggtaaaagagtcttcaagctcatcgtcaatgttttccgttggatctattataaattcatgtatctccagatttttcaagttattagtactggaaatcctgttcagcccgtcaagaggctgttgcttgagaaaggaaaatctttcatttacctccaactcgtcgtcgctaaccatcaatacatcactttcattatttagatcgatgtcatcatcattttctacgatgtcgttattaaataatggttcgttaagttccctcctaccaaaaaactcgtattcgtagtagttaccgttttcggtacgatagtcggatatcgaaagccttctctccaactgatttgatgaagtagctgtagttacacaattgtcgacaatagtattgcctgttagatcgttgataatttctacattattattgtcaatttccttggcattggcgttggcatttggtatgagttgaagggtaaaatgttgcttgtcgttattgcggctttcgttaaacagctcagtcttagaattcaaagtgtaactgaaaaccgtgtcatttgattcaaatctttgtaaagggtataaagacatgcttgtctgtctatgttatcgtaaagctttatttgtccctggatagtttatgaagtctagcaggcctactgtacaaattcaaaacagaaaatcatcatcttgctcgaagccagcccatgctacctatggctctcagtcgcccattcagctatctatatatatcttggatggccacgctaggaaccgcgccgggcaacaacttgggcaaaagccctcggaacagtaaaagccacctttccgtgggttatccgctgaaattttttgctccatttccgaagcgtcgcactcgtaaccgtaaatgtaaaaaaacagcacccaattgggccatgtgtgattaacgccgggcggctatgcacgtttgaacaagtatatccgcatggagcaacaactgctataagaaattccgtcagagaaatggcttgacttgctgcaagcacagaggtgtttatggataatatgtatacaataacctcataggtgtttggcagtgtgaattcactgttccctgcgttcccggaatggagaaaggggtatgacaggcgccaaaaaaaaaaaacactgaaaaacaagagaaaagagtaaaggagatggcttgaatataatatttattccttgctaagtttaatagcgtattttcttatattaattccgtggacgatcagatgcgggaatacaatgttggcagttatctgtttcatcgctccctccttgcgtaaatatcgaaccttctatcattcgataatcaagaattaaaactgacagccgcgccttttcggcatcttctggggttgatcaaaattataataagaggactgctgcatatttacctccgtacaccttctacacccaaccttattatggggcctactaaattttcttttgagaagaattgcgttcttttcatcgtgttgtgtttttttgagatctttcgcgcgatggcatctcacattcgcagtttgcatgaaatttcagatagtattgacagcattcgatcgtgcaccgggaaataacgctaggcgtctatcgtaacataacagagtgttttattatctatatagtgatatttaccttaaattcttgctcttaagcgtgtctcaatttactttcaaaaagaaagataaatacacataatcaaacaggaaaagtatgttataagagcgaataatgtgataaaggagcaaagtggaaggaaagaattataaagaatgacgttgccgtaaagccaatttttcaaccaacaaaattgcaatagtttcaagcaaattatggtgtgtccgggattggcggtagtaaattgtaaaacaatagctggtcaatagttgatattcataccgacactataatccacaaaagatgggtgacattgatggctgaaatggtagaggcaagaaaattttttaaagcaataaggcatagacgtttctattaatcctttgttttattcagtattttcgatatttcctctttactaacttcaatttactgaatttgtatgtaatttttagatgccaaaaaagagagcttccaacggtagaaacaagaagggtagaggtcacgtcaagccagtgagatgtgttaactgttccaagtccattccaaaggataaggctatcaagagaatggctattagaaacattgttgaagctgctgccgtcagagatttgtccgaagcttctgtctacccagaatacgccttgccaaagacttacaacaagttgcactactgtgtctcctgtgctattcacgccagaattgttagagttagatccagagaagacagaaagaacagagctcctccacaaagaccaagatttaacagggataacaaagtttctccagcagctgccgcaaagaaagctttgtaaatatgatgagagaataatataaatcaaacgctcgctgattaaggtgtcatttattttttttaatagaggctttgtcttttataattgtgtattttaataatatgattatagtatattttcaagaatagaatttttgcgcatgtaacttcgttcatactcaattcacagtaggcagctgtatttgtatccgtactactggcgtacgtgcgatgaattaatcgtatcctacggcaccttgtaagcagtcgagaaatttttttttcactttttccttttcatacctatataaatagaagtgttcttgtcgatttgaagaaggtttatttcgtttcgctgtagtttttttgtcattgatcttttcatttttttatttcaaaatccccatcaactattacagtcgatgaggataggttatagttcatgtgtaacatctgtgttttaaaataactctagttatccggggcgtttttcacaaagtttgtgtaagatgctttcctgggtcgatgtggattgtgccgtggcctttttcaccacctttatagcggtgctttaactattaataactgaggctgtattttgaattcttacgtaaatcttggaatctatggagcatccagtctcacctgggttggctctggtaacgcatgacttggtatgaaaaaattgttttaatttgacgaggaaattttggcatccgtgaagttcaatacttccttaagtattggttttcaaaaaaaaaaattctaaaattctaaaattcttctattataccaaagttataacgtctataaatatctataactgaaacctgttttgtcataataccttgttttagttgtgcttttttttgctttatctggatattatctaatatgtttatcttcgtttaccgaaaaaaggaaatggggcaatattatcgttatcatttgtagttgcgtcttctttcctatttgttctgttggcagtcgctgatctatcctcacaatgcccttcactctccttacgtccagtattcactgcagaaggcataaaggcaggattcatgaatagagcagatgtggaatgtgtcgtctgagtactgaatcttttattcatatgttgtctccgttgttgagatgcagtgaaatctgtaacggaagtcctaggtgagatctgagtggaaggcgcctgtgagaatttgatggacgatttcctgaatccctccgagatcggggaacttgatgcaaattttaaagctggtcttgtattttcttgctgttttaacggtgtcgcgacatcagagtgctgcctacttagagtaggagaagaagatccgcgtgcaaaaattggttttccagtctctctcatttcgtcatccatttgtgaaatgtcttgtaatacctttttttttaactttttcaagactttggataattcgattgcttccttcgtgcgcgtcatcaagttactgtcattaaccaatacagaagttctataaatagacttcatgacatagtcgacaggtggtagtgcattgggtgagaccatattttccaggctagatatattaacatattccgaaccatcttctctttgtgaattaggtctaatgtatttggaaaatgatccatgtaatcttgaagagcctggagtgctggatcctattttatataaaggatcaatagaatcatcaaattcttgagatgtctgctcctgtaattttttattcatttttgtgaaaggcaaaatacctagctgtgaatcaaggtcatcagaatcagagcggaaggaagaacctgaatcactatcaaaactatcacgaataaacgggtctgtctctaaattggatgagttttgaggtatttctgttcctctgttcttcaatggatcattagtgcggtctaaatctttcccatcgttgctgtttctcttttgcaacgtttcaaccttgtatttatcgaagttcgaaatgtcctggagcgtagcttgttcgttttgttcctctttatcgtccgaagctctgtttgacttactagagtccaaattttggtaattatatctcgtaggttctgtgggaactgtttcagtaaaactactacttcttcttggaaagttctgttgccggctgactggtccactatcaggaacatcatcagtaaattgatcggaggtatctaatggatctgtttccctacttaagctggatttcttcttcgtcgctgggctaaataaggacacagagcggcgaatattttgaacacccgaattactggggaatgcaattgaaccaatcgaattatggctgtctctaggaccaccggcaaaaacagtaggaacagccctattggcaagcgatcctatgctagaaattcccgtgtggtgcatatctatttcggtttctccattactgtcatccgtgtagtgtattgattgcgccattgaagtgtttcgcaaaagatatgaatcaacgtatccgttgtctatattggctagggaacgttttatctctaaggtgtcctgatatgattcgctagaatccaactgctttcttattttgccctcattttcattgcaatatctcgaaaccttttgctggaacagatttagtagtgcttcgcaagtaactgaaagaccttcttcctttttgctgattatcttatacagcacttctgtaatcagttcgtataaaattggaatttcgtatattttagccatgataagcaggtccagggtcacaggagctaatagccatttgccattaatttgtgcggtgtaaaagaactctgcaaatgctcttacagaggcggtcgaccaaggcatatacaatgatctcggggttaataagggttctaactcgattatggcgttattgttcgaatttgtactttctacactttcagggtttgaaatgtaagaaagtcttctactcttttcattattaatatatgattttgaagaaaaaaattcaccttctttgaaattgccgtttatattgattgcattaatggtggaaaagatgggccttatattggaaggtgagatacagccgtagtcttgattgtccccatcttcctcttcatctcttccattgttcatgccatattcttgaatacttgcttcgtaaggaatgtcactgccataactattacttagcagttgcgaatctagagtattcctcagcaaagaagagttagagatacgccttgcatccgaggagctcgattttctggtggaatgagaagaccttcttgacgcgactggactatccctaccaaattgaacgtactccgccaaggaactgcttcttcttgagggtgcttttggcaccggcggtagtggttctagtgggatcttttcttgtgggggtaatgggatattcaacacaggcaagataggcgagtttggtaaacttgcagagcttcctaaatgagaaatttggttagagttgcgccttcttcctgaagtagaacttacaacagaggcagtgctggcagtagatgcaaatgaagtctgtcgcgactgatttggacttgctataaaccttaatgcggatgattttctacgtgagaaagctttttccgcgggactagcctttgatatactactgggtgaagatttggctataatgtaagattgaagagggtgtgaggctctccgaatggatgaaaagccgtcatctaccgaactattcgtggtggttcccactgtggaagctcgcctataaactaaaggtgtattggaaagtgtacaattgctatcattaccatcgttagttgattttttatataccggaggaggtgaaacagagcttgctcgagtagagcgaccagactgttctgaaagccccagctttgaatttttcatgtcctgaaagggaaccctaaagaccatacctgtagaagagcaagtggtggatatcggccttttgttcgaggtgcctgtttctttcaggccagtatctccagttgcatgttgttttaacgtgtttgaccgactgtcctcctcatccgcacaaagtatcggttctgaaggagatagtttattatgcgagatggctcgctgcttgggtgacgatgttgatgaagtaaagtctacgctatgtggtttcttaagacttgtattactgttcgatttactatttccgtttttagaaaagtatttttctagggatccgttggatgattgactagagttaccaaacttggtagtttttgaggctgtatgaggtgaaaaacttatgatattagaagtgtctccattaaactcataattgaaagatgtatttgcatagccgtttgataatagtgaatcaaaatatctcccccatctttttctcaataaatatactggaacaccgatagaatcaccatcagcagtgataaattcgaaatcagataaagtcttgccgaatatttctagagcatctttacctaaaaccatagcatatggcggaaatatagaactagttgattccatttctaatggtacagttatatatctggaatagttctcaaattgtgaggtcgcagtcgaagtcaagcgggggatccctgagtcgtctaaggaatatccttgagttactgtgtatggatttgtgtgctcaatcgttgatgaattagagtatggaagatgatcataaagacttagatttacgtttaagttatgactattagcgatgccattattagtgcgtgtgtgtttggtattcactaatttattatagccgtttaacattggtaaagagaatgataaaatgtgatcgaatttttgaacgctaggtgaacaaaaatcatctgttctggtaccaagtaataaagcttgatgatgagacttccaaatcagaagcttccaaaatctatgcatactaatactgcactcagtacatgctatgtttactcttatccattttccactagcgatattataaatgaaacaatgaagattggaaggttgggggtctggataaaatcctattacaacaatgttataattaaagtaattacctgagggatactgcaagtgaaaaggtacttgtaaaatagagttttctttgttgttttgtgtagggtttgatgtcatcctagcgccctgagagtttccaagtagtggcaaaattacgataggcgacataagtgtttttactgcgttttcatctgcatcatcgctttcaaaatacttaagatcgccatgatggtgatggtgatgttttggtagtttggatttgtcgtctagatcatgagcgtaagtagagaaactaccatcgtcggttccccttctggacgtgtttgcctcgcgttgagggtaatataatgccaatgtcggaatttctgcctgattattttcaatcagaactgagaagttggaatcgtgagataaagaaattggcatcccatcaatattaaccagtatttttgacgacccctttgaagctgggttttcgtccgatttcgattctgactcccataaacttgtacgtaggttaaatatatcaatttttttaacaggaatatccatattatctaacccacctacaatgattagcttcgtatcttgattttcgttattttcatttaggacgtgcatactatgattaaaacgtcttgtaatttgagggttttcacttatcaaagaccagcactttgttttaagatctaatttccataattcgtttgttgctatcagctcatagccgttgtgaggcgacaccataagcccaccgaaaatgtaaatgttggattctgtgaagcacatcgaatgaaacaatctctctttaaagcttaagccgttattcaactcattttctgatgtagtatctattgtagtatttattctttgccatgttctggaaattaaatcaaggaaaaatatctcagggcttatccaatcagctaatgttttaaaatcagcatttctatccttctgtttaccaaaatatagaattagctccttttgcagttgtaatgaatttataatagtcagatttaaaggtagtgtgagcccaccatggacaaaaacacctgaacgggctagttctactgcagctccagttctgcattccaaagtgagcttcttccttgttgcttcatccagattgggattcggtacaatagggaggttgagcggataacaaacactagatggtggttgtaatacggtcatttttaaaaactttatgctttcacctaattatagaaacgcgtactaatgttttttgttattgaagaaactggaaatgactaaagaatactcaggcaacgatgagcatagccaaaaaaaaaaaaaaatttgttaaaagtgatactggtaactttaatacaatatccaaagtttatgatatcaagttggaaacggtgtcgatgtggactttgttagaggttaatctgtatttgtgactgggctctgccaaacttactatcttctattatctaggctcaagtaagtaagatgaaaaaaagaaaaagaaaaaaaagcagaaaaaaagcagaaaaaacagtaaagtgggtgtgagtgcactggaaagcctgtgtaataagtttttgatgtactgtattccttgcgagtattatcacaaagctctactgtgtttgcactgtgggcgtatagggatatcgcgagggcaacgcaaaactagcaagatacacatattccatacattaaagcggtaatttttagtagttaatttcgaaatttcaaacccggcaatgatacgcacattaagaaaagggaaaaaaaaaagaataaattggccatagaaaaattctgttatccactagacagaagtttgcgttccatactgtcagaggtggcattttacataacaatagtgacaaaaaataaatttcagaaggaaggcaacataagtttttctaatcctaaaatctttcgattttgtatcagagattgttcacgctaatgtcattcatcatagtagatcatttatctttcactgcggagaagtttcgaacgccgaaacatgcgcaccaactttcacttctacagcgtttgaccaaaatcttttgaacagaacattgtagggtgtgaaaaaatgcgcacctttaccgctagcccaagagggcactacaaaatctagagttgtacttcaaacgtacatgtaatcaccttgtatatactcgaaagaaaacatcaagtttctgtataaatatgagtgaaagcataatcatacattatcttttcaaagatgaagagtgggtgaattttgagataattgttgggattccatttttaataaggcaataatattaggtatgtagaaagtactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttactccaacaaaagaattacagtcagtggctgtttgctgacatttcattgcttcccttacaacctgatttccattcgagttgaaaggttgagaaaaattgcaagacttctctctcatctaccttccccttttcttgaagacaaggtgagagacaatttagtactaaagcttttgcggttgttattcaattgaggtagatacctggcaaaacatttcttgtgagcacaacctcaattaaagttagacaagtaggtgcactattggttgcttgttggctcatctcgttgaggaatgtaataactacttgttattaacctgtttttgtgccatctatagtggagagcttattgcaatttgttttttatttcttgactgcatatatcagtctttgacaggctgcatggggatgacagttagaaactagccaaattaccccttatgtagataacaatcattgcttattcgctcttcccccattttttttcttgctcttgctgttttttcttttagcgttcgtttcaaggaacaagagagggaaaaaaaaatcaaaagtagaaaagaagaagaaaaaaacaacgtaacacaagttaacaccacaactgaaaaaaaaaataagaggtgaacgaacgagtaactggggagaggaaagcagattaccacaatatacattcaaattaaagaaatggactcacaaccagttgacgttgataatatcatcgatagattattggaagtaagaggatctaaacctggtcaacaagttgatctagaagaaaatgaaatcagatacttatgttcgaaagccagatctatattcataaagcaacccattttactagagttagaagccccaattaaagtatgttaatgttgaacttcgcagtcaagagatagaatgcctagagcttcaggtgttttatgtgttctactcctgttgcggcagtaagatagttacagcagttatttccgtttgactgaaagaatttaccaagcatctgatgttagcctactcatatgtcgagatagccgagataatgtgtgtgtttagctcttcatttttctatcttattaggcatttttttaccaagatttccttatgttttgtatcatcatccggccggcgcctcccatattcagaaaaatcccccttgctcacactaaaaaaagaaggcattttttcgttatgaagaaaacgaatcttttttttttttgagcccgagagaaaggtcggacgaaaaccaagaaatgtggatttgcagaaggcattgggagaaatgaagcgtttttgacagcagtaattgttctcttaaagtcaacggaatgagctagatttagtgacaaattcatttactaacttatttttttctattttttttttttttagatatgtggtgacattcatgggcaatactatgatttactacgtctatttgagtacggtggattcccgccagaatctaattatctatttttgggtgattatgtcgaccgtggtaaacaatccttagagactatttgtctattactggcttacaaaattaagtatccagaaaactttttcattttaagagggaaccatgaatgtgcttccattaatagaatttacgggttttatgatgaatgtaagagacgttataatatcaaactttggaaaactttcacggattgtttcaattgtttaccaattgctgcaattattgatgagaaaatcttctgtatgcatggtggtctctcaccagatttgaatagtatggaacagatcagaagggtgatgaggccaacagatattcccgacgttggcttattatgtgacttattgtggtcagatccagataaagatatcgtaggttggagtgaaaatgatagaggtgtttctttcacttttggtcctgatgtagtgaacagatttttacagaaacaagatatggagttgatttgcagggcccatcaagttgtggaagatggttatgaattctttagtaaaagacaattggtgacacttttcagtgctccgaattattgtggtgaatttgataacgctggtgcaatgatgagtgttgatgaaagtttattatgttcttttcaaattttaaagccagcccaaaaaagtctaccaaggcaagctgggggtagaaagaaaaaataaatagattcacgtcctaaatcaaagtttaaaaaggaaaatacttattaacaagaagagtagtagaagaaaaatacaagaaacataaacgtagaaaacttttagtcaattctttaagcgaagaatacgaaagaaacatcaagaaaacaaaggaagatgcaatcatcactcgtcatatacacaaataattccctttagtgcaacaaaccgcgaaaaagcataagaaacataaaaaaaatataaaaaaaaggagataataataagatgtgaaggatttgaattagtggaaaaatgataagtctacactattattattaacgaaatgcaattttcctttattttcttttattactattatcattactattattattagtattattatttttttacttatttttatattaaactatgttaaattactatattattattttgtctaactctatattgaggctgtctttcgttgcactgttaagaatggtcacgtcttcctttggctttgaacccttttataaacaagttggccaaatcatttagtcaatcacgtcaacctgtctaaaataagacaggtaaaaaagaaaatgccatctcctagaatcgaaccagggtttcatcggccacaacgatgtgtactaaccactatactaagatggcgacttttcaatggagaactgttgtattacgggctcgagtaataccggagtgtcttgacaatcctaatataaacagtcttagggaagtaaccagttgtcaaaacagtttatcagattaattcacggaatgttacttatcttatatattatataaaatatgaatcatactaagtggtggaagcgcggaatctcggatctaaactaattgttcaggcatttatacttttgggtagttcagctagggaaggccgggttttatctcatgttgttcgttttgttataaggttgtttcatatgtgttttatgaacgtttaggatgacgtattgtcatactgacgtatctcattttgagatacaacaagaaccgtatccttattttgtacttttgtgtaaatatttaatgaattgtttgagcaattacgaaattgtttggaatccaaaggaatcttcagtaaatttgttggaatagaaattaattggcttctattaatcagtgcgtatgttactggtatattgggaatgggtgaacaatttgagacagttgttggattccattgttgttaaaggctgcaatattacgtagaacgaatatgctgcaattctcctcgagaaaaaataggaatctacaaaaggcgaatcgatagctctacataataatgttactttatcttcttccttttatactttgtcattctttttcttattacgttatcagttcttgcatttcaggtgctattatatttggtgactatttctcaatctctatgacatcttcttataccgtacgtgataatataatagtgatatgaataccagtcgatagacgatagttagttgggttttatttaacaaataggttcccgagaaaaagttctaatattttctatttacccaatagtactaccccatcaaataatagaatcatagtaattatcagtaacaaaatatacagccctcatcagcaatgtagtctcaacaactgcccccagaattcaccgcttttcttcgatcgtcaatatggaagtgaggaaactcgggctcacttaaaacgaactgcatgttttaaaatcattatccatgcaagtgtggcataaaagccgtagttagatatatctcaaacgcgcaaaaagttaaaaagaaagccctgtagggggctcgaacccctaaccttatgattaagagtcatacgcgctaccgattgcgccaacaaggctcttattgttgtttttctgattcttatggagggattagagagcaaagtaaagtacttatatgtaatttaacattcgatgaaccgcggataattagtaatatgaaatgggtgatgttcataatgtagagaatgtggattttgatgtaattgttgggattccattgtgattaaggctataatattaggtatgtagatatactagaagttctcctccaggatttaggaatccataaaagggaatctgcaattctacacaattctataaatattattatcatcgttttatatgttaatattcattgatcctattacattatcaatccttgcgtttcagcttccattgaaaacgatgactatttctcatcatttgcgtcatcttctaacaccgtatatgataatatactagtaacgtaaatactagttagtagatgatagttgatttttattccaacacataattagaatttaaaaggcagtattggtgaagattgaacattaattttcttatgcttatataatagaggtatgaacacacgcatataggatcattatatagttatggctagtattatcatggctctggtaatttcatacatttgatgtcgtcacgactcatattatttgctcatatatataacttcctcatatatataacttcctcatcaagttcaattaatagatctttagttcaaattcagaacattctgaatttgtcgtttaacatttccttctgcaagagtacattcacactggaacgtatacgaggtgtaaattggtatactgttggaataaaaaccaactatcgtctatcaagcgaggcgctgaaatcctactattcgctcgaaagaccgctgaacgcaggagattcttttttgatcttgaatatcatttgagtatttttgttctacattctagttttaggaaaatcatcaatctatggcaggaatcaatagtgttggaataagaaatgcatatttgcctgcgaaaaaaagttattctttttttttggttaacgtagttaaactactctgttaaaaataatgggttaaggttcatgttcgtcacataatgtttcgtacacttaaaattcaaacgctatcagtagcattacaacgtgtatgaagatcattggagaaaagcagatggttaagagcttcttgcactgaaatttgaaaatatttgtctgaacttagtagtgaaaagtggtgaatgaaccaggtttttatacatagatatatggttaagttatgaaaactctttttggaagaacaaattagtacaaaggctgaggcggattggttaaagtttttaaattaaaagtgagcttctattttgataaatcacaaatatataatttttaacagtgatgtatcatcttcccataaatgtaatgacttcttcttatgctcagatgatgctctgtgaactaagtgcgcagtccttcaaacctttccactcaggtaatcttgataaagtttccaagatggtccattctctgggtctcttacataaacaaacttcactccgtatttctccacttctttgtttctactttcatcatcaaataaacaaatctttttcgattttaaatcgctggtattataaagatctttcaaaccgtcccttaaatggccaattttacttctttctccccactgaaattcatcgaacaggttggccaacggggttacgacaccagcatacttgaccttgaatattttcagtatttcctgggcaatctcaggtgcccacgttcgtgacgcggtcattaacttaactccattatctttaagatcacctagtatacgtgggatatctttgtagattgtgagctcgtaaccatctctacatataattgtgagaacttcgccattactacttttaactggcttaaagggaccgtgcaaatgggtatcacaatagcagggccaaatggtgtagtccaaatcgaaggcggccacgtcagggtatccagtcataataaacgcgttgagactattttggagcaggatttgtaacaaaattgttctctttgtaagtttaaggacaaaaatgcttgtttctcgagaaggtctccttttcggcaggtccttcttctagtgcgtgaaaaatattctactcaatcccttagtattctttgtaaacaatacactttaaagaaatatgaatgcttatctgcttttcaacaatcattttagagttcttattcactgaggtgcgaatgggtacgaaatttgtttcaggagaatttagcttgttgcacacaaatttctgccatttatatctgcaagatctgtttccctctttccaactagcgaggcatattagaaaaagagtgaatagtaacttgtgtaagttttgatgtaacggtagtatagagtacctataatattcgccgattatattctcaaaacttgtaaataacgccatgtcaccgtatggagaaagtgctaaccaaattgtaatatcgaccaagacctttttctgtgaattatgtaagtttcttaaagtccatgtcatgcttgaaagattttaatcaaccttgcatttgtggtcgttaaactcaaaggggatattcaaacgacaatcgacaactaacttcgaataaactaagattcactttattgggatataatcaattacccttcattaagtggtgtatatgttcctgacgtattgtcattttcgggataagaggtttgatgactatttctcgattttcatgtcatcctctttacaccgtacgtgataatacactaattacacgatataactgagcaatgatattttagagcttcatctccacaatttcatgtgtaaatcttaagaattgtagatatattctattttttaatgaaactttttcaacaaattaggtttcgtggtctagtcggttatggcatctgcttaacacgcagaacgtccccagttcgatcctgggcgaaatcaattttttttttcgaaaacgttataatttacgttaatttacaaagggcattcctttcatactaagcaatgtttacttccaatctcttgagacatcttcgaaactagttgaaaagagacaaatccgcttaataactaatagttacaagaatggccaatcaaactcttgccaagcgatacaagctttacaatcctgtaacaaaaacatacttttagcggttccgacggtattcttctttttctccatatattttgcttatgttggctactttaaaataattaccgcttcccccaccagaaactaaacatgagctaaaggcgcaaaacttaaaaaattacatagccaagactgttttcaagaaaaaaatatcagaccacatttgataaagtacatacctctgttaactcccgtaatacacccatattcttgtactttctacaatctatcactcaaacttctctattatccaacatctgctgttgcatagtaaagtaggccgtaaacgctcaaaaccgttatctttaggttacccttatgtttgaatcgtttatctcacattggcggtgttttcccctctcctgtgggctccaaaatcttggccgtgggaagcttcagcgagggattgtagatgtagtttcaacacgtcggctgatttatcccgattttgttagtagaaaaggttctacttcattcttgcttgagacgtcgtcccatcaaatttctaacatagtcttttttcaaggaaggatatttttcaaagcaggactgcaattagtcttttccttttctttactccccttccatcataactgttagtgaataaccacttatatagcataacacaatggatcaagaaacaatagacactgactacgacgtgattgtcttaggtaccggtattaccgaatgtatcttatctggtttactctctgtagatggaaaaaaggtattacatattgacaagcaagaccattatggtggcgaagctgcttctgtgaccttatctcaattgtatgaaaaatttaaacaaaatccgatcagtaaagaggaacgggagtccaagtttggtaaagatagagattggaatgtcgacttaattcctaaattcctgatggccaatggtgagctgacaaatattttaatacataccgatgtgaccagatatgtcgatttcaagcaagtttctggctcctacgtttttaagcaaggcaaaatttacaaagtgccagctaatgaaatagaagccatttcatcgccattgatgggtatttttgaaaaacgtagaatgaagaaatttttagaatggattagctcttacaaagaagatgacttgtccactcatcaaggattagacttagacaagaataccatggatgaagtgtattataaatttgggttaggcaattctaccaaagaattcatcggtcatgcaatggctttatggaccaatgatgactacttacaacaacctgctaggccatcgtttgagaggattttgttatattgccaaagtgttgcccgttacggtaaatcaccttatttgtatcctatgtatgggttaggcgaacttccacaaggatttgctcgtttgtcggctatttacggtggtacttacatgctagacactccaattgatgaagtattgtataaaaaagacacaggaaaatttgaaggggtcaagactaagctgggaactttcaaggccccattggttattgctgatccaacttattttcccgaaaaatgtaaatctactggtcaaagagttattagagccatctgtattcttaaccatccagttccgaacaccagtaacgcggattctttacaaattattatcccacaaagccaactgggaaggaaaagcgatatatacgttgcgattgtttcagatgcgcataacgtttgctccaagggtcactatttagcaattatttctacaatcattgaaactgataaaccacatatagaattagagcctgctttcaaacttctgggaccaatcgaagaaaaattcatgggaattgccgaattatttgaaccaagagaagacggctctaaggataacatttacttatccagatcatacgacgcatcctctcatttcgaatccatgactgacgatgttaaagatatttacttcagagtaacaggccacccattagttctaaaacaaagacaagaacaagaaaagcagtaaattcatacctttacgactaaagcagcaattggagggtaaacttattttttccgataatgttcttggcaaatgagttaccaataaatgacatgaattacagaaaacaagaaaatatttgccaaaaaaaaaccaatacaaaaatataggggaaaagattatcctttattcctttctcattccactttttttttttgttatatgcgtattctgattgattcataactaagtatctttccttttcttttctttcaatttcttttttccatatataaatacataaatttacataccttatgtagtataatatatggaagaatgctactgaacacatcagtacacatgctatgtacttacaatcttagtaaggtagatgtaggtctaatgcttcgatgatcccttcattatttcttgggtataactgtcagtctcgcaccgcagtgtgcccttgtgtggccagcctcgtgacaaaatgaacattttatcttattttttttctttttactactctttttgctggttactccctgaatagtgctcgtagttttatctgcctcttccttggctttaatcggtatcagggcatatttttgatcgtctttttccatgatctctattccattccgcagtaccatgtcaagaacactagtattcatcatacttcccacagtgctttcatgcaatcccagtagtaggttaatgaatttctctaattctttcaacttatgctcgtactcaacttgtaattgtgatccatctttttgctttgaaatgatcaacttagccaggacatccatagcttgtgacaatctgactatatcattttcagtcttatttgatgattcacacattccttgttataacaaccctcggtattcttttaacaaacttacgatgactatattgtattagtgtcaacctcatcgccaggaacttttcattgaaaatcttctgacaaattttctgtgtaaaggaaagaaaatggagtataaaatcgaaagtttattccaattgtgctaggctgtaatggctttctggtgggatgggatacgttgagaattctggccgaggaacaaatccttcctcgcggctagacacggattgcacgccctttgggcaagggatagttctctattccgcaccgtgccctgttgtggcaaccgtctttcctccgtcgtaaatttgtcctgggcagagctgtctgcccggaggcgggagagtccgttctgaagtgtcccggctataataaatcgatctttgcgggcagcccgttggcaggaggcgtgaggaatccgtctctctgtctggtgcggcaaggtagttctgggtccttaggggctccaccttcaccgctgttaggggagttttatccagcgtcagcaaaggtgacccgtgatggaggcggccgggatagcacatatcagtcggataattgtgcaagttgatcgcttcggcggtttaatttggcggtgccatcaggatttactcgcacattgtggccgttccctcggggatggagtgtgtcctgaaccatattttttaacatttttttgaactaattaaccgtcccaatgagggatgttggaagagtaagttgatttaatgtcctattcttgttcttttcgaatataaatgacgattggaaggtgcatgtcaatgtttatcatcatgttcttgttgtaggtagtccttaccttggttgtagagtgagtagcgacaggcggcagcggaatataagaaggataaaatgagaatacttagaacgtgttgaaagaagaataaacgatcatccatcgactagtactgctgctactagtgtgctgtcatactactaatatattatcatatacaatataagaagatgtcataaacattgaaaatagtcatcaaatctaatggaagctgaaattcaagggttgataatgtaataaaataaagaatgacaaagtataaaaggaagaagatagagtaacattattatgtagagctatcaattcgctttttgtagattcctattttttctcgaggagaattgcagcatattcgttccacgtaatattgcggcctttaacaacaatgtaattccaacaattatcttaaaatttgtctatatttttaaaaaagtatgaacaattaccaacatgtggtacatattggaggcccgcaaagctgagttggcattcattcattctttaagttgaacaaaaagacaaaaagattttcaaaaaaaatatggtctctagcgggatcgaaccgctgatccccgcgttattagcacggtgccttaaccaactgggccaagagaccaaattttaatgaaatacttttactggaaagaaggtaacaaaccatggaagatgcttttctaccacccatgaaagtctgagatttttattaatgatgttggaataaaaatcaactatcatcttgagaaatgggtgaataattagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgtatcaggtaacttagattatttaataatgggacagattcacttatcgcgtgtatttctgcttccgtagttgaagtacatgttaatgaagccttggtggactttcctccaattacctttccattaagtaaatatatgttgccaatttgtgatttataatacggttggttgccatacgaagcatcacttattgcgactagtttattatctggctcggtaggtttgtttttgtgccatatcagttgtttatctctagtgtcccacatgaattgtatcaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaataaaatcatgtcgtcaacaaataaacatattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcttgttgaagataaacattgagtttattactcttttagggtctatttcttttctgtcataatattcgtcagtgtcccaagttttcatcttcaacagttgattgacttctttgtggtatgcctcgatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcgatgtcagattggaagtcatggtcagattctatgttaagatcatcggattgttggatctcatttgacgcaatgaacgattgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggttcttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgtgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtgtgatttaccgtagattcagtaagttcctggcctaaggtgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcagatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttctcacattcttctgttttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacacatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatatctacatacctaatattataaccttaatcacaatggaatcccaacaattacatcaaaatccacattctctacaaatgaagaaactgcttatagtcaattgaacgatttaccggtattttaacgccattatatatattagtaaaaagatggcgtatattgatggactaacagggtcaaataaaatcatgaattgactagtatatacttataagtatatcgttctacacaaactaggaagatgacatacatgatgagaattggttatcaaattccatggatgccgaaacgtaaaagatttactaaatagtaggataattattgataacatacaaaacaaaaaaaaaagagacaatattattatctagaagtgtcgacttccttctgtgggtttcctatgttctcgaaggagcttcaagtgtattctataaactaagaatattagtttaacgaaagatcgaagtcagacacctatctaactttcattaaattatcacacaaaaatcccacatactctcgtcttgctaaacaaataataaattgaaggtgaacgattcttcttgcagcgtcctagctgttgggtcgtcttagataaatatctactgttctgaattgccaaattttccttctattgtatccattcgatgctggacggccagttctaccgttattgcccaaaaggaaggaacgtcgcgatacttcaacacattaaatacttgttgattttcgaaccaaaactctgaagcaacactttcgtatatggatggcccttcagagaaaccaataggtatgtaaagaattgctacgtggtgactcaaagtgaattatagcaaagttataaaagcgctacattgtagaaaattgagaaccacattttgacatacacgaataacagtatttttgtcctggcgctgtaaagtattttaagttatgatgatgaattaactattttcagccaatgaaacgtccataatctgttctgaatttaggtgcattgatatagccggtcaatcttcccttgtgaaatcacccaaaatgctgggattatcattctcaacaattttgatttgtgccaaccacttcgataaatcatcttccagctcagtatcatctttttctgtagtcccactgtcaggatttaatcctaactttttgagaccggatatcaatgatttaatgtcttcttcggatgccttttctcttagcaactcttcaaacaaagtcactttgaaatctatatcgtgtttgtcctgttcaggatcttcaaataggtgaacccctgttcttgcaaataaagcttcatcagatagttgcacttgataaaattgggaacatctaaaatggaacttactgcaatagtgcgacaaatatgcatacggattgttttctaataaaaatttcttagtagtatcattcattgaaaatggatcacgtattctttctggcgatttaccgcaaagaggatatccgcatcttttgtttagattcctctcatctactaggtcttgatacatatccggtgtgagaaatcggcccaaatatttcaatgttttctcatccttgcattctgaatcacataataagcctataatctctaaagttataacttctgcttcatgcatggaaagttgcctgtgcttttggaaagggattaacgccgtttccttaatatcttcaatcgtcgccatttcttattcttgttaacttcgtcctaatttttcaaactaagatgccgatgtatagatattttagactgggaatgtttatgaattgttcaattcgctcctcaatgtgtctctttcttcacttttccattgcttttgaccacttctggatgccagctgattttgtattgtagtattcctatttcggacaaaaatatcggaaagagatgaaataagaaaattagttacttttaatatcacgatgctgtctctgaatcgacctgatcgatctataaggtgtatatattattctaccgagtaatccaaaaaaaaagcagcactcccatgcaacacaaggatacggcagtagcgaaggacacagctaaaaaacgtttactgagaagaaatagtgcgccgtcagctatacatataatttcacgattagacaaaaagtggtccttcctatggaatactatagatagacacaatattgttgaagagcaagatgaaagtagcgctgcaaaaagcgaagaagaacatgaggatgattatgaattggaacaattactcaacatgataagaataccaatgttcctggaaaagttcatgctctttgcacttttaacaagcttggactgttttttgtattactttactgtattaccgatacgactgataaagggatatgtaaagcaattcaagagttatcgtcagcattatcgcctgcaacaacggtctgggcataagaataaaataccctttcgatatagaataacttcaagagaatataaagagagatgtatgatttttatcatcgtgatttcatccattttgttgagcaaactagacacctcaaaactatatcacaggataaaacggcaaagtacgatgaaattgtacatgctattcagtgtactggaaatggcggacaaaatgttggcaagtttgggccagagcttattaacggttatgctttctaggaaaaactcggaacggatattactgcataaatgtttgttagtgtcaatgagcttgacatatgtgactatacacggctatgtattggtttaccaggccatttcattaaacatagccgtgaattcgtattccaatgccttgctaactttattactatccatgcaatttgcagaaatcaaatcatcggttttaaagaaatttgataaggagggatttttccaaataaccattgcagacgtagtggaaagatttaagttgaccttattattgtcaataactggccttaggaacctccagtcgtggtcatcttcattatcgaacacaagcatcaatttctggagtccacgttccacattatcaatcgtcattaacatactttgtgggccgatggtaagcgtggtagggagtgaagtgttagtggattgggcaaagcatgcttacatcacaaaattcaatcggatccgcccacagatatatgataagttctattatataatatacaaggattattctacgagaacgcacaaattagaagatagattgggattgcctttacctgcattcgttgtcctttttattgtaatggtgaggccaacactttttaaatcatcggaaccttcttaccttccttcgctatttaggatcctcttcatgggggcatccgtgtttttactagcattgttggcaaaatttacactagatcttattttaatcaaatggagcaaacggatagagcaacggttcagagaccaagctttcaataccgttgtaactgaagaagaatacgtcccaggtttactctcgggcggtatgggtaaagtcgacgtgtctacaagaattgcattacattctgattacaataaagagaatcgtatagagaccgaaagtgtatcgccaatgcggaaaagaaaaactactttaactgctgaatgtactcctcctagcctaaatgatattagaagacagaaagattccaagaatccacgatcgcttgaaaatgtcgctcgctataaaatggtttctaaaagaatatggtaatctaagatccgcatttatcgcggcttacggctttcggatatttcgtatattgcaaggagcaaaaaagaaaccctgcttactaaaaagctattgttttgcagtttataagttcttgccttttgaattattgatctttcctttatcgtttatttagtttcctattgtaacttggaactgtattatataatagtgcacagcactgaagttgtaactactgtacgtcatgcttttcagaaacatagaagtgggcaggcaggcagctaagctattaacgagaacctcgagtcgtttggcctggcaaagtattggggcctcaaggaatatttctaccatcagacaacaaatcagaaagactcaactatataattttaagaaaactgtgagcatccgtccattttctctctcctcccctgtttttaaaccacatgttgcttcagaatcaaaccctatagaatcacgtttgaagacctcgaagaatgttgcttactggttaataggtacatccggtttggtatttggtattgttgttcttggtgggttgactagactaacagaatcggggctgagtattaccgaatggaaacctgtcacaggtactttgccccctatgaaccagaaggaatgggaagaagaatttatcaagtataaggaatcaccagaatttaaattgttgaattctcacattgatttagacgagttcaagtttatattttttatggagtggattcatagattgtggggtcgtgctatcggcgctgtttttatattacctgcagtttatttcgctgtatctaaaaaaacttcaggccatgtcaataagaggttgtttggtctcgcaggtttattaggattacaaggatttgttggttggtggatggtgaagtctggtcttgatcaagagcaactagacgcaagaaaatcaaagcctaccgtttctcaatatagacttactacgcatttgggtaccgccttctttttatacatgggtatgctctggactggtttggaaatattgagagaatgtaaatggattaagaaccctgttcaagccattagtctcttcaaaaaattagataatcccgcaattggcccaatgagaaagatttctttagctttgttagcggtgtctttccttaccgctatgagtggcggtatggttgccggtttggatgctggttgggtctataacacctggccaaaaatgggtgaacgatggttccctagttctcgtgaattaatggacgaaaacttctgtagaagagaggacaagaaagatctgtggtggaggaatttgctagaaaacccggttacagttcagttggtccataggacatgtgcgtacgttgcgtttacatcagtactagctgctcatatgtacgctatcaaaaagaaggccgtaattccaaggaacgcgatgacctctttgcatgttatgatgggcgtcgttactttacaagcaacacttggtattttaactatattgtacctagtcccaatatcgttagcttctatccatcaagctggtgctttggcgttgctaacaagttctttggtgtttgcctctcaattaaggaagccaagagctccgatgagaaacgtaatcattaccttgccacattcaagcaaagtaactagcggtaaaattttaagtgaagcgtcgaagttagcctcgaaaccattataatggataaaggtattcttatgagaattgacagtatactcgcttttccgctttgtcgctccaatggttggattgtatgtgtgaggctttttcttattatatgttggtatccctacgagaagctgtaaatatgaatttctttagtaggcatcacacacaacaatagggtgtatttatttttatttttttttttcttatataaatgtcagtaatacatgatatctttaagttaggatttcacgaaattttcttctgccttcatcatggcatctgtatttgtgctcgcgagcctccaaagtatgaacataaacacagacctatacggagaaaatgtttcagagcatttttccattatgtcgtcgtcatatattttccagttgtatttcttatgcttaatcttactctttttaactacttttctttcacgcattaattctttttccaattctggcttatctgaaaggtattttgaaaaacccctagcaatacctagatcttcaggagcaaatacatccattcttttcaatccggagatcaagaacattttggcactccatgggcctataccttttacattcgtaactaaactttcaatcacttcctcatcattatctttttgaccgaagagcttttcgatatccttatatttttcagtaaaatagacagcaagagactctagatatatcattttccttttactcaatccacattttgcgatttctgcacattttgctgggtctttgaagtcttcgaaaaggattttgtaatcaggaaatgcaccgccataaagactgacaacccttgccttgatgctttcagctgcttggccactgatctgttgagacaaaattgtgcttgcaagcctaataaaataatcttcgagtgtattagggacttgagtctccttcaagtacaacgtaaattcattattcttaagtatgggaaaaagtgatggatctttctctaaaatgtgttcgcaagccatattgaacttttcttcatgtctagcaatatatttctcaggaagagcaacctctagaggtcgagaccctaattcttttgctatttccttaacagcgtctgcttttattaactcatcatactccctttttagtttcattgagaccaatccctctctagcttctcttgattctcagtaaaaaattaaaaaggaaaagtaccacttccatcgtcatatcagagggcagtggccaattctcattgattcatagataacttaaactttatgtaagaattcccgtcgccaccccgccctgtaaattcatcgccaccgaaaagataataataccaaaatgatatataaagtaggtcgaataagaaagtatacttaacgtagttaacaaagtacataccaaacataacagcaaaaatatacgtaaagatggatttaacaatttcaaacgaacttactggcgagatatacggcccaattgaagtcagtgaagatatggctttaactgatctaatagcattactgcaggccgattgcgggtttgacaaaacaaaacacgacttatattacaatatggacattctagactcaaacagaactcagtctttaaaagaactagggctcaaaaccgatgacttattattgattaggggtaagatttccaattccattcaaacagatgctgctactttgtccgacgaagcgttcatagagcaatttagacaagagctacttaataatcaaatgcttagatcacaactcattttgcaaatccctggattgaatgatttagtaaatgacccactgttgtttagggaaagattgggcccgctcatattacaaagacgttatggtggctataacaccgccatgaatccttttggcatcccccaagatgaatatactagactaatggccaaccccgatgatcctgacaacaagaagaggattgcagagcttttagaccaacaagctatcgatgaacagttgcgcaatgctatcgaatatacacctgaaatgtttacccaggtccctatgctttacattaatatcgaaataaataactaccccgtaaaggcatttgtagatacaggggctcaaacaacgattatgtccaccaggttagcgaagaaaactggcctgtcgagaatgattgacaagagatttattggagaagctcgtggcgtaggaaccggcaaaattattgggagaattcaccaagcccaagtcaaaatagaaacacaatatattccatgcagttttaccgtcttagatactgacatcgatgttttgataggactagacatgctgaaaaggcatttggcttgtgtggacttaaaggaaaacgttcttaggatagcagaagtggagacaagctttttgagtgaagcggaaatcccaaaaagttttcaagaaggacttccagcaccaacgtcagttacaacttcgtctgataagcccctaacacccaccaagactagttcaactctaccaccacaaccgggggctgttcctgcgcttgctccaaggactggtatggggccaacacctacgggaagaagtacagccggtgctacaacggcaaccgggagaacgtttcccgaacaaacgattaaacagcttatggatctaggtttccctagggatgctgtggtaaaggctcttaaacagactaacggaaatgcagaatttgctgcatccctccttttccaatgagcaaccactgatattgtgatcggcctctacgtatgtagcccataacacaaatagataagtataaggatgtacatactttcattgtttcgtcaattgttgtttgtattgtatatgattgtacttctgttaagtatataatatgcagattgtatttgtgcctcaatgtgcgccattcatgtgttgcaaaccggtaatttgattcaaaaaattctttcgtaaaataaaacatatgcactgggtgtgataaattcagtactaaacgttataggacgataaagcgagtcatcgaaaaaataccaacctttttttggtcccttataaacgtatgaagtatagtgtcccccatacaaactccccgaatgacatgcaaccccatacagtctgtatctaaatggtggtacttggcccctggtaggaatgtcctcattaacaatagcttcatgattaaaatctctcgcccaatatggtgtaagatctaaggagtaaggatattggacaaacacattattcttattcatttgattgtcaaatcgtttcaaattaataattagtttcttaggcaatctagtaatcttcagttgtttagtggaaggctgcttttttaagcatttaggacatgaccattgttcatcgacacctaacctttcgcatttggtgaattcccggaaacagtctaatatgttacaagttttaacgcgtgggacaggaacagaaagaacagagaatgtttggtaagttgtggaggtatgttcacaaacttgacattgtagcctagatgcgtactgtccttggaaaaggtcaattatcgcactgaagtcggtaagcaaaaatctttcccactcgagagcactagctttgcgtatggacattttttctctcattcgttcttcctcatctgataactgtttaagatgctttttgctgccgttttggttcaaatcctcgtgcaagccatcaagcaaaaattgacaaaattcttgacaatcttgctgcattgaatcactatacatggggttgatatggccgcaaatttttttaaactgaatagtctgaactggtatcgttcttacgttaggaggtgtgaatgcaccgtgtctgtgcatattattgaccaagatggcgaaatttttagctagcaaccccttagaacctcttgaactatcaaaattaataaaattcagatatgtgttatccaaaaacattcgaaccaaatcgtgtgttcccaccaaacattgaagtatacagttcatataacaacagttacctatattttccaatcctactataagatctagatcaagcacttgtgagttgtttaggatggtctgcctcgacgaagacaagttctgttgtggtaaaggcggaatacgtggcgagaatacattcgatgcagggggcaaataggcatgggcttgtgcagcgcggatatctggcgatattctttccacagtgtttgctttattttgaatggtcgagggtgtattgagttttgagagagtggttggtggatgtggactaaatttttgaacggtgggagaatttctgttggggcttggttgcggtataatgggcaaatctgaatagtataagggtaattgaggcctttgcaccgttgttagcaaaggctgcgtattcatggataccatcggcatactcttatctttatttggagatagagatttctgattgaacaagcctgttgggacttgcggactaccaaaagctggcgttgaagacgaggatgtaagatgcgctgtttcactgacagatgattgatacgccccacctaatttaacccagtttgagaacccattttccaaaatgagtattttcgtcccactcagcggtttaattactgaattttgggaaagaatcttcgcaaggatgcgagtttgcctttgctggaaattattatgcaattgagtgtcagtatataaaataatgaacttgaacttgtctcgatttgaaaagaaagtgatatctgagtgcggcgaagtgatcaaagagacactttcaatttgttggtctgtaaaagaatccttaaatgaggcaggatcgatgcatataatgtttttgcatttgatatgggccctaacgaattcagacctgggccgtacatcgataagcaagagagcgtcaccatgaaaatgcaacattgaacttaattttccaggctctatagtttgcaactgtataaatttagggtaattttcaatgacatttcgaatccgctcaatatttgggtcattatgcaaaagctggattctctccccgtacaaatttctaacattctggtccttgttgctcgaaaattcctttagtcttggtagagtatcctccaagagcgtatatacgatcatgtaatataaaaaagctgtttcattcaatcggagaaacccctttgacaaccggtttgcatcttctttaggggcctgcatggttatatcctggcatgcgtccacataactagaccatatttctgcgcattcttggagcaaaggcagacactcttgtggcacgtcgtcatcatcaagaaacttctgaactaaatgcctaagcctgccgaaccgctctttagcagattcgacaacctcacttaaggcttgttctgagcccattacgcttgtgcctatttgtgtagagagataataaagaaaggactccacatacgttggagaatacctagcaactaaatatagctggtgtttacttgatgtgttgaagtgaggcgcaaggaaaaaagaaaaaaaatcaatgcccggtagatcaattggaccaggggttcttgttttgcgacgccgtacagacaaggccaactttataaaaacgatattagaaattattgtatatatgtatataaatgtagtatttttatcaacagaaaataggtggaaaactcccaccctgtgctagacttcattcaaagagagtcggctttaacgtggaggacttccttgtctgtggcgacgttttgagacgaggaatgactggtagtttgctcgggaagttcgtagttctcttgcacattgatctcaccatcttcattgaagttgatgttctccatcttggcaaacagttgtctcttttgctcttccgtcaactcctgctttttcttgttcttgatccagtatcctgggttcaagtgtttcaattgtaagtttttggtgaaaggcaagtgaccacgcctttcttcgaatatcattaaactcaacacaatgataagaaccaaccaatagatgttgtaacaaagcatggatgacaagtagccggtgttctgccatccaagcaaagcattgaagatatcccacccattgtccagttctgggttgcaacaattgacatggtaaacggcctttctgatgttataagacccattaccatcaccgccttcggaagcatcaccaccactggcaaggttgaatctgtaattttcaaagtaccacgcaccacgagagaaaagaccggcggagatcaggtacaagatcgaagtagacaaaatcaagaaaatctgcagcgaggatttcgaagcaccatagtacaacaaatacccaacaagaccaccacatatcaaaccaaccacaacgggcaatgggtaagcagaggcgtgcgagccctgtgtggtaatacctgcaccggcaacgaacacaacagcttccaaaccttctctcaagacagtaataaacggcaaaaggaacatagcatatcttctactcaagaacccaatcttgaaatagtctctcttacggtgaggaatctccaccaacgaccgcgcaatcttcactctccacttactctgcatcttattcattctcaacataggaatacccatcatcgagatcattatcgtcgcaatcatacaaaagataccttcccacaagtcttccgcgcttccgaaaatatccttctgcagcgaatagtacgcaccgatgaaacctgcaccgatggccagacaaatgatgaacccgagtaacacaccgacccaaacctgaatccttaatttacggtacagcgcccggtcatgttccccgattgcctgtttcaaaaacgatagcagcacggaaataacaatcactgcttccaagcactctctgaacacaacgaagaaaacggccacgttaaacactttgttaggcatggcgggaagtatatgtgtgatgacctgctgagagaagatttcgacaacgtacaatccgtcgtgttatgtatttttttgctcacattgagcattttatataactaaaagctcaaggtcgaactacagcccatcgcttccaccgggccttgcaacaccaacttagaaatcgggtgcattcatctacgctgtgcagagaatgaaatgcgcaccttcttactgctgcgacggtgctcggcacggcttacgcgggcgggggaaggaaatagcggcctggcgtgagtcggcagtcagcggcgggctcactgtactcgctcgtttaatgcaccagcagtattcgcgcacttaataatagtatttctgcaccctggcctggaaagaatgctcgatgcgccctggttgattggcgcagagcgtgtgtcagtgccggacccgatttctttttttctacacgttggtctgatgtctcaggagttagtagtgaccgtggtcaagaaaaaaacaggacgaaaaattgttgagaacgtatacgtatattgtattcttcttttttttctttgctgcccttttattatctatttcattttttaaccagaggcaatcgtaagagagagataatatagccctttttggtcttttttggcaccttcagccggaccctgctcttttattacccggatgctcgggttttgtctttgcatccgggtagcaaaacagaatacttgctttcttattgaagtagaaaaaatacagagaaagcgaaaaaggcttccttggcggatagatggtctcacaacaagcatagcgtatacacgtgcactcacaagcatacacagaagcgcgcaaaatgagtctaccggagattttgcctttggaagtcatagataaaacaattaaccagaaagtgttgattgtgctgcagtcgaaccgcgagttcgagggcacgttagttggtttcgacgacttcgtcaacgttatactggaagacgctgtcgagtggcttatcgatcctgaggacgagagcagaaatgagaaagttatgcagcaccatggcagaatgcttttaagcggcaacaatattgccatccttgtgccaggcggcaaaaagacccctacggaggcgttgtaaaaaggcaaaaattaacgcgaatttgtatagtgcatctaaaaaaaataattaagtataaaaatagataaaggaaatcaagtgtttctttttttttttttggtttattgtttgacactggtgatttgcttaaccagcgcctccagcttcgcgttcgtgagagcgacgtcttttccccgcatcgccaccgtacaattcattaaatgccatattccgatcacgtattggaccttgcgcatgccgccctgctggcggcacatatcgaaacactttgctgaaatcgcatagatctcgcccagatcgtgttcgagcattcgaccgcctaagtagtttaccagtatttgcagcaacagagccttcttcaatttgaagcggttgtccgcaacggcttctccggcaacgaacttgttgctagagtagaactcgcggagcttcgacacgtactcggcgcgctgcttgtcactacatggcagcgggttccaactgaacggctcgaaatggctgaaaagccataggatcgttactgtgcactcccatatggggttgaactgcagatccgtttcttgtagcaatttctccacctgaagccacaccttgttgcattgctctacgagttcgccctgtttgtcccccgaacatcggctcactcttgccgcctgcactgtgtagcaattcagaagcgatatcatcttcacctcgctggatgtaccgccagattgtgcaagccgcgtgtactcttctacggccccgccgccttcaaactgaaccttcatggcttgcagcagcctcacgtagcctggagagggccctaacttaggtgactcggtcgtcactacggcccccttcaagagtgtttgttcccacactttgtaaaactcacagaattcaagaatgctcttgtatgtctggattcgtgagtccagctcattcatcgaaacaccgccagcggcaatgttcttaatcagtttctgcgttgtagaatagactttggggaggaacttcctggaaaaattgcccttttcgtcataacagttcacgatgtagctgacactttgcaataataacagtatgttctttaattctttgtagtggaaaatcataggcaactctactttcagcgctatccttggcatgattttgatcacacatcccttaccttcattagtgactagagattgcttgtttgtgtcaaagaaatttttgaattcgttcaagtggtccgtaatattcccgtctttacaaagctggattaccatctctaatgccaacttccatgcatatagctcaggccccaccgtgtgcagctccgtgcttcgcagctcctgcagagcatcctcggggattgggaacctctcatttagcaagtaattcacataacacagatttagaaaccatttccattgtgacttttcccgacattgcgagagtagcccatgaaaactcgtcttcaccctgcggtgctgtttcagcttaatgcaaagcatcacgccgacatactggaatacggatgcccaattttgatacaactcatcctgcaaatttaccatgtactggactaattcattgcaatttcttagtgcaatcttatagtggaacttactgtctctcataagtggcaagtcatgtaacagcagaaactcgcaacgcatgatctcttctaccaaatctgtgtcgctctggtgcgtttgtaaccgttctttcaaactggaaatgtaaagctctgctaggtcaaaattatacgtctcctgtatcaataactccaccatctcaaacgtgaccttactatcctccagaactgaaagcgtacatttcgttttcaatagctgaaacatctggatagacatgttcatgaggccataatactgcttcaacccttcctcagaaccgattttattcgcaattgaatatgcatggtctctgtattcctgtgctaagtggtatacttgtgaaatactaagtttgtcgccaagattttccatgaatttgtacttctttcgaaatcgttcaatttctaccaatactgattcccctctgatagctgagatgtcgggattccctttgctgatagatctaactcatctctttacgtattttaattgtgaagccgtaaatagttatcttccaagtttctcttacgcgagctttttgggaaaagaaaaaaatttgaagatctacatataaaacatggcttcaaaggattactaatgactttttttaccttgataggtattcttgatggtaagagtaaacaagggacgtgaaaattacagtagttactgttttttttggactataagatcgggggaaagataacacataagaaataaaacgactactagttagactgctctgcggaagaagcaaggaagtaaaggctgcattttatttttcttttctagtccaacataaacaggtgtatcaagagaaacttttttaattatggccgatgaggaacgtttaaaggagtttaaagaggcaaacaagatagtgtttgatccaaataccagacaagtatgggaaaaccagaatcgagatggtacaaaaccagcaactactttccagagtgaagaggacataaaaagagctgccccagaatctgaaaaagacacctccgccacatcaggtattgttccaacactacaaaacattgtggcaactgtgactttggggtgcaggttagatctgaaaacagttgcgctacatgcccgtaatgcagaatataaccccaagcgttttgctgctgtcatcatgcgtattagagagccaaaaactacagctttaatttttgcctcagggaaaatggttgttaccggtgcaaaaagtgaggatgactcaaagctggccagtagaaaatatgcaagaattatccaaaaaatcgggtttgctgctaaattcacagacttcaaaatacaaaatattgtcggttcgtgtgacgttaaattccctatacgtctagaagggttagcattcagtcatggtactttctcctcctatgagccagaattgtttcctggtttgatctatagaatggtgaagccgaaaattgtgttgttaatttttgtttcaggaaagattgttcttactggtgcaaagcaaagggaagaaatttaccaagcttttgaagctatataccctgtgctaagtgaatttagaaaaatgtgatggggaaggagtagacgaaaagaaaaaaaggttttctatttgttccattttctcaattattaatggtcctcaaagaaataaaagaaaaggaagaagaagtaattgtaatatcaaacggttttttatagtatattcttcttattctatatttatatatcaatgttttataataagatgtttattcatagcatatctggtggatcgtctctattaagcgccagcgaggtgtttgcctctgcatttttcagcaaagcaagctccctttccagcttgaatctatgttcacgctcatccgacaattctttttcatactttctttgtgtactcgtaagcacttttttaaactcacttgtcattattgaaagtgaacgtgatccagaaccgcttgtggggcttcctacagaggaaggtgaacttggatcccaagtcaccggcgaactcgctggtgatgacatgccgaaattatgtctgcttgaattcagcttgttgttggctttttcaagttctttattttcctgctccaattcgtgtaatttcttttcagttttactcaaattcgagtggttgtttaataacttatcttgtaattctctgttagtccgcgttagcttctcgatatcttgtacatattcggcacggtcattctcgaattgcttagtcaagaaattgtgtgccagttgcaaatcactaaatgccgtttctagttcttctaattttttagaggagtcttcctcttgaattgcagcggcgttaggcgaaataggtggtgatgacgtatttttttctagactgacgcaggtatccaagatagaatttatcccatttttcaagaacttcacagggtcatctaatggtattggcttgatatcaatgcctttctgaatggagtttgacatcaagaaggacgttaattcttgaagtatttcatttttatcgtcatcagctttgtcagtatggtaagcacccttgttaaatttatctgtgccacccatattagtggaagacctcgctcttttagaatttgggaaactgttgttgttttccttcgtaagctggtctatccctgtagtgttaatggattcaaggatcctcagcatcatttcataccaatccgcagacttcggctgcagcttcagcaactcattgagtgtgggatttagatcatcagagttcaagtgctctttttgaacgtagtatagggcgaactcagacactagctttttgtcaaggtctatttctgactcgtcatttttacttctatacagaagatagtcaaaatagtcaatggaagtgtatggtctactattgtgatgcggatgtgacggattttgggagagaaggtactgtttcaattcatcgtatttcaatggatactcttcgtatcgttctgcactaaaaagcaaagggttcgctcttctcgagagctctagatcaaatttatgcatatgaaacgtgatatccaccgttattctccctctcgaacacaggacttcgatagtatcttttgtaatctgttcagctcaactatttgttaccataccatcatcatcactttacacatactcatcatgtgtttattgacgcgagcgcgacttgcaagaaaaggcataattgtggcgaggtaatgaaaaatttttgacgtttccctcattcattcatacataacattttgggattttggaacaaggcgagaggagaacgtctttggaccactgtaatagtacacaatgcaagatattttaagtttatgctaaaaatccagaagtgacgcttcatcaacggtgtcaatatggaccgaattttagtgtatcttcaattgtaaccgtgaggagtagactctttgaatacgggggaagaagaaatatcatattcaaagctaattcattgaaattagtgcttgtctcatctagcctttagtgcttaatctctggaggagcacatatggggttaaagccatgccgggactgggggcccctatcggggctcgaacccgaatcccgcgagtatttatttgaaggtccgggacgcaagttacctaatctggttaattgatatcccatttaggcgatgacgttccttcccctcacccctcggcttgttagaagatctattgttatagcctcctctggaagaatttatgccagatgaagaaaaaaacttctcgaagttcccagatgcccaaatgagggctttccatccctgttagctggaaaagtgtaagtatatctatataaaaagtcggcctacttttgccaggttcgtctttcacttgcactctcttgatcttactttctactcaaaaagaatccaatacacaaaaataaaatcagtactattactaataatgttgtctaacgctaagctccttctatcattggccatggcctctacggctctcggattggtatctaattctagttcctctgtaatcgtggtaccatcaagcgatgctactattgccggtaacgatacagccacgccagcaccagagccatcatccgccgctccaatattctacaactcgactgctactgcaacacagtacgaagttgtcagtgaattcactacttactgcccagaaccaacgactttcgtaacgaatggcgctacattcactgttactgccccaactacgttaacaattaccaactgtccttgcactatcgagaagcctacttcagaaacatcggtttcttctacacatgatgtggagacaaattctaatgctgctaacgcaagagcaatcccaggagccctaggtttggctggtgcagttatgatgcttttatgatcgaatagtctttaactagagacttattttaaacaggacatgtgttttttactaatattgtattcttcgatgtagtcgttatagttctttttcttcaaatcatttaaataaagaaactattttttctttttgtgtgtagaataataaatgtaattctagttcttcctttttttttttggctttttcacagctcatcttttttacccatttggtcatgattatgttgtttgccgttgtgcaatagggagtttgtaaatcctgagataaagtatggtgcttcgaggttagcacttaattggcgtaagctgcttaatgacaaaaccctccttgggcttggcgtatacgaaatatgctcctgcgaagcgcagtggcaatattgagcactatgttaacgataacgtgttggactcatcgtctgtgcacatatgattgaaatcgggaatcctctgctttttttaggtaaaatcaaactttggctaaatttggatgattacttaaagtaagaaatgaatcttaagagatgtatgagttttgtgataattgttgtgattccattgttgccaaaggccataatattttgaaattcacattccttctacaaggtatttgtttcttaaatgttcatctccaagaaataattggtttcgtggtctagtcggttatggcatctgcttaacacgcagaacgtccccagttcgatcctgggcgaaatcattttttaaatatgccaagcataaagtgtaactctgtttctctgtctgtctctatttcttttttaaaatcgtgctcactatcgtattgtattgtattgtattgtattattgctatattattttttatgtattttgtctataataccaccccccgtcttaatttctcttttgatacattaaaatataggcagtcctcgaatcagaagcttcttcgccacctttcaaaacgtcatcgtcctctagttcggtaatatttacatcatctattctataccatttgttgtgctcgctatgataaacatccgctgtgtaatgaccgccatcggaacttaccccatgatggtatataactccggttagcttatatcttctatcatcaatccctgaggtgttgtttttcaatgttatggaagacattgattcttcaggtatgattaactcgtgaccatatttaatttttttcctgatcttctcaatacgtccattgtacgcgttatagttcgtcattgcgttgtctttgttcacattatttatgaatgagaatcttttgaattggattaaaagaacttgcggcaatttatcaataaaagtctgcttcttggcctcgacatcattccctgacgaggacttaaagggtagcaattcgtattcactaaattttttgaatgcagtttctagatcattcacaccagcatctgaaatgtccaattgaattgtttggaacggatcgagtgtaatcgattgagattccttattgttcggtatatctaacacagatctgaactggccaccgaaaagtttggagattggtgatggaacaatctcgacagtcctcttggcagcggtcttagttttcttgcctcttttgctagatccgctcacttcatgccaaccattttcttcggtagagtcatcattgatcacgccatatttttctatcaactccttcagtctaggactagcatttttgataaactctgcttttccataacgtgacaaatttctaataaagaaaactttcaattgttcatcattaatactttgcagcatattttgaatttcattatcggttaagccatcaattgcagaaattaattcctcgtgtaattggtccaataagtgggtcaaaaattcttctgcgtcttcctgatggccccattgcaagtctttgaacttcggtatagtagacaaagttttgtaaaattcgtcaggtttgacagcatcggcagtggcgcagtgttggaaactcttggattttgatgatttttttgcatcactttccgtggttttttcagcatcatcagcattctctaggaattttttctcataggtttccttatcgaattgcttatacatagtcaaacaagcatctaataatttacaggatgatgtgccgactcttgaattggtattccgtgtactgagaacgttaattacatcaataaatggcttacagtagagtaacacttgtaacacagaactcataaaacaaatgttggctctgttaattatgcctcttggaataatggaatggactggtattttgttttcaacatctttattccgtaaaacgtaactaatgaaatcgggatcaaaacacattcttaacgcaatcgaacccagtggctcaataccctttgtagaaggtggaacgtattttttatcctttttctgaggctgcttggacaacaggggagagctggatttacctatagtcgccgcagccatgtttgttgatgaaacgcctgcggtcgtaccagaaattggtgttttagtgaccatcgatccggagactgttttgttactagcttgtctacttttaatcgcatctgatgctatggcggaccaggattttgctgctggaggagatggtgaaggtgaagatgtcttggaagtattttcttcaacagattcctctggttccttcttatccactacaggtaaaacagtagcttgaggttcctgtataactttttcgttacggtcttgcttagcatcctctttctttacttcagttttctttttaagctcgtgcgcatctttgctcgcatgtggttttttatcatgagcatcttcttcttccccatgtgtttctgtctttacttcctcattatgctttggtatactatggctttttgtgtgatgatgggcagagctcttttctacagatgagttctctaagctttcagagtttaggttcaaagccttcatgtttaattcgtacctttggacacttgccgcagcaaattctgcttccgtagtgtttatgaacagtggcaattgaatcaagtttgatgaattttccttgagattctttaatttagtgacatcaaacttgtataaatcatactgtgaagaagagttgtaggaagagtacgatggtgaagtagccgaagaaccgttgccgttggaagagttggtctgttttttcatgcccgcattgctgccactgtttggagaggccatcatggggatatgattgttagagtaattgtgatggtaggtgtgggatttgttgtagctcatgccgctaccgctagagttggcgccttgattaccgctgcttccattgttattggtaatgccattagagtgccacttcttcttgttaatgttgttgttattggtagtgcttccgccgttaatattgttttgcggaggcaagtgatgtgggctgccactttgatggtagattggctggttttggttgaccatattaaacgaataggcaggtatttgtgtggggtatagatatggggcctgagtgtagccgtacatctgcaaaggcgcttgataaataggaatctgcatattggttggcgtaggtggtggtggagaagaggttttcgggtacatcgagtacgactcttctttgttagcgtcttgcatgttcattttttttaatgatgatggaaaggaaagcggtacctggatgatggtagcagacgagtctgacttactattaaaatgactttcttctctagaaacacttctcttccctttcgctttttcgctgcttgtttgttttatcacattatatttttttccttctttttctttttcttccttgcctttgcccgtagaaaaattaccctcttattaccgttcacctatatacgtattccttctacatagttatgttattggtgatcgcatgagatttgcaaacagcaccaaacagctcaatgcccctgtcgatatcatcaacttctaagaaactaatagaaagcctaaagcatgactgaccccagtttttctcatcgccgatgacctcgaaattggagccgtcggcaaggatgacattaaatttcttggcaagaatagtggatatctccatggcattgtacgctggtgggagagtgatccaagtaaaatagccgcccttcaatggcataatctcggttcctaggggcatgtatttcttaagcgccgaggtcaagacagtggccctctcggagtatacggatctcagatgtgcaatgcatctctgggcggcaccactacgcagcatctcacccacgatcatggagttcagttgtgagggagttccgccagagacgtttgcaccacctttagatagctgtctggcgagattcgcgttgattgactcatggtatccaaatctgagcccaggggcgatcagcttggagaaagttgcgttggacactgtattcccgaacgagtcctcaccggagggcgctgtacttctgtctatgtgcaccatccttaggggcggagagggcagctcatctgagggcgtcgtgtaatctagaatatcgtacacgtcatcagtgattatcagcatgtcgtacttccgagcgatgtcgataagtctgcgtctggtctcaagcgagtatgtgtttcccgatgggtttgcaaacgtcgggatgcagtacataacgtacctgtagaccttcttggtcaactttggcccctgaatcatctctgtggtactatggggctgcggctccgcctcgtgctgctcaagggcagaaatcaacgactcgaaatcaatcgagtcgtggccctgctcgttgatggcggtcattttccccttgaatcccgcatctgtgaagcaattgttgatcaagaaatatgttggcgtgatgatgaacgcctgcctggtatacccgttatgtggcaaggttgtttgcagaaggatgttcagcatgccatacgaagcgccgctattcagattcaaatagtctgcccgtgtcctgctccgagccccattttcgaacttaaacagctgatcattcagaaacgtacaaatctgctctcgcacccacagggcaccttcgtccgaaccgtacgtcagcggatgcctgttataggggtcgttatcgtactccctggtctcgggccccaatatagccgcagtcgcttgaattactgcttctcgaggcagcaacctcgagctcggatggcccttgaagaaattgatttccttgtatttcattaccgcttgctagcacgcgttgttccttgttacagcgatgctccacccagatttatgtgttgatttcaaatcctcttctctttatcactagttcggcatccagcagcggcagcccgcgataactttgacggaactccgccagcacacgtcgcgcctgcgctgggccgggaacatgccaaaggacaccagccagtagtagcggtagtgaccattcgttctttatcactaggggctgtcgtccaaacaacgccagggcagctgcttgctcatcttgctgcatcaatgctatgcccatagccttggtcatttgcgggaagtcgcgcagccttaatggcggctgccctggtagcgtatccatctcctgcaagaataccttccacttttccctgagcgccgtggagtgcattgtgccacgcgcaaacgcttcgactttaatccgtctaagctcatactcaatcagttcatcttctgggctggtgcgacgatcgcgattcatcgcctggtagtgctggaggaactgcgcgggtaagaagagcctgtcctggtacaatgctacgccagccatttcacatagcaggcggccctctactggcaaccggcgtggcatcacatgctgataccacatgtatgctatagtgtcggcatgggcaagcgcagcggctcgcgctagcatcgtgtgcagcagctccacatccacgctggtctgctgctgctgacgcagcagcgccagtgcatcggacattttcccgtttaaactgcttaacagtattcgcgaccgcacatcggtggtcaccagtcttttcgtgatagtcaacatgacgtgttccgttcttatgttcgagctaatgcctcgtctgctcttccacgttcagatgttcccttgattgctcaaaacactctcagcaggccgagatttcgattttagccagcagtacggaagtaatccgagccatgaaaaatttaaccagtggctcgccctctatacgtatctgttcacgtacaagcggagccacagaataacctccccgacgatgttcaaactcacctctcgactcgtcacgtcaaggtttgctgcctcttccagactggccaccgctcgaaccatagtattgccccggccccatccgtcatggatctcttttcaggccaaaagatttaattcgacgggcccaaatgccaacgatgtctcggaaatccaaacccagttgccttccatcgatgaattaacctcttcagctccttctctttccgcttctacttcggaccttatcgctaacacgacccaaacagtgggcgagttgtcctcccatatagggtacttaaatagcattggcctggcccaaacctggtactggccctcggacattatccaacacgtcttggaggccgttcatgtttactctgggttgccttggtggggaactatcgcggccaccaccatcctcattcgatgcctgatgtttcccctctatgtcaagtcctctgatactgttgctagaaattcccatatcaagcccgagctggacgccttgaataataagctaatgtccactacagatttgcaacaaggtcagctagtcgccatgcaaaggaaaaaactgctctcctcgcacggcattaagaacagatggctggccgcacccatgctacaaattccaatcgcccttgggtttttcaacgcattgagacacatggctaactacccagtagatgggttcgctaatcaaggtgtcgcttggtttacagacttgactcaagcagacccttacttaggtttgcaagtaatcactgccgctgtgttcatctcatttacaaggctggggggtgagactggtgctcaacaattcagttctcccatgaagcgtcttttcactattctaccgatcatttctataccggccacaatgaacttatcgtccgctgtggtcctctactttgcctttaatggtgccttctccgtcctacagacaatgattttgagaaacaaatgggttcgttcgaaactgaagataacagaagtagctaaaccaaggactcctatcgctggcgcttcccccacagagaacatgggcatcttccaatcattaaaacataacattcaaaaggcaagagatcaggcggaaagaaggcaattgatgcaagataatgagaagaagttacaagaaagcttcaaggagaagaggcagaattccaaaatcaaaattgttcacaaatcaaacttcattaataacaaaaaatgaataaaggctctatatctctctgtaaatataaaaatataaaactcaaaccctcgataggcgggaccaaattttttctctctcagcagtggattgtatacatttaccacgaaaattgtttattgcttgaaataatcatttggattcttaataaaatcttgcaggattgtctgaactgcacctaatctggaccccatgctgttggctaagtcttcttggtttataaaactcatggaaaatacaatagccaagtttgatgcgtccattttattatttacaacatgctgatgtactttattcaaatgaaatacaattcttttcaaagtttggtaatagcatgtaggtaacttttggagtaactcattcatcattctcttgtattcttcatttaccattgcatgtgctttatacttaatcgccaaatcggtaaagtcgttcaccatagcatgagaaaataaagaatctggtaactctcttaaatacatcttaaaacagcctgcgatcgcattcacttcaaaccatctatcgtcctctaatgtaaaggaattatctgttgcaccttcttcgtcaaatgcgttctttagtgcatttatactgccgatggaaccaggaattctgtacaatcccacttcatctagcccacgcagctcaatctcttccagcaatttcacaacaattgtaggtatcaaggtattctctctttcacaaacgtcttctaatggtaccccaaatatcttattatgagttttacctttatattttttcgaatggaatgaaaatctcttggaagccttgatcatttttatccattctgtgaggtcactagaactagccgtttgaatcagatattcatggccattttgcataactatcttgaacgcatagtagtaagccggaatgtttctgtgattgattatttccattattgacttgatttcaaaggtcttcaaactataactaggttttaagtcgtgtagttgcatggaatcaacctctggaagtatacttggtagaatggatttgttacttgaaacttcttgcgataatatactgttgagtgaataattagaactggatgtgttgaatccaccgattgaaaatggtcttctgaaaaatccacctatttttttactaacaccattatggctggaatttgacactactgatgatctatttgtggaaaaggaggcccttgaatctcttctattccttgctgaattattgctttccataacactacctagagaaggcgtttgaccggtgttcttattgatattatagctatgatcgttgtcactatgagtacctgagataataacagacttcctattctttttcggaacggcctgatgtaaagcagcagagttcttcaagatcttttcttgatcgagtaaaacctctaattttctggcttccctctttattttttcaatttcattgactagtatttcattaaatactccctgctcttgaaatctctccgatatggcttctgattctgatacttttttagtcttctttctgtatactttattaacatcttcaaaattattgaacagaatgcggccaaatgtagttcttttcgaaggattttcgtcactcatttcaatatcaagtggaaactccctttcgttcggaattaaatccaagacattagatattatgttgttaacaaatctccttttgtcaaaattaataagtttcgaattagtgatactcatgttagggacaaactgagatatttctagtaaccttgaaatgaaccaaccagggcaggggcataaattcttgcagtttttgctgaatacatcatcaatctcaatgaatctctttatatgtatgtcatctatcttctctaaaacgttactaatcgatcttagattttgggttcctttagtagggtccgaaagtttttcagaagctttgatccacgaaagttcatagtttctagactctggtgatattatggcatgcgcaatagcagtttcaataaaagctggaatgtgtggacaaatagcatgaggactttcatcctcctctgaatcaaataaatccaaacttccgtttttccagcggatgtagttcaaaatttgtaatataactttacaagtagttaacctttcactactgcttttgttgacgtttgaaatttccatcacgaaaaacgtagttagactcgtgtgtaactttattaacaattttatagattgtggtagtttttcaaaaaaaagactctccgtaccattatcatccttaagaatcaatgtagaaatccaagtaaaaagattggaaatttcaaactcgtgcaattgcaaatatccggggtttatcaatttgcttgacttaaaatgtagcggataattgaaaaaagagaccagagattcctttgaaagcaattccaactcctggaaaagaactatccaatctttcttagaaactaaattgaacttcttagaaataaagttatctaactggtagatccattctagtatatcttcgtaattggttgagtgtaacttttgaaaagatctaatcatgtcatcgctaaaggaaggatcatcaatgatgttgttaagatctgtaaaagagaatgtgttaaaggaattcaaaatgtcagttattctcttctgagttctattgacaccaataggtctgtatagttgcttttggtatgctgatttaataccatgaaatagatcagttaacgtagtcaacaaattttctgtttcaatcacaaaattttctggtaggcttttttgtaactttgagtttgcaattcgcgtaggccattcagtggatacttcttgttccattatttttataatatccaatagagtagagttgttacataaatcgtcagtaaagtcagagtaatgatttttcactaaatgtagtatagcttccgcggcgccgatttggatttttgccatataaataaggtttatgttttcatcgtcagttactttcatatcccaaacaggaaaattttggtcgtataatgaagaggacactaaatttgtatcctcatttatcttcattttagaatcatcactgcgatctaaaatcttggaaattgacacgctgcaactctttgcaccaacataccgttttgccatattttctaataccgtagttgtagtagtaaagcttttataagtgttgaagaatgtttctgtgaaaatatcattgtccatagttagtttaacgaatgcataatctagtagtcctatgttatcatcggaaagccctctggtagaatgacccctttgtctttgatgatagtaataattctcaaggtctttagtgtctaccaattttgaaaagatatttgaagttaataccagtaaatcaaaaatcttttctagcgacgacgatttcaatacgacacgaataatcgattcttttagtgaatctgatacttgaccaatattgttgaaaaagtccatattttctaatgtcttacttagtcttccagtggtatccaaggaatctctcatcttttggtttggagtagctggattattaataagcatggaagagtgttgtgagaatctctttggtgtttctatgaccatactagcaggacgggatttaccatcattatcgtataccgatttaaatactaactcatctgatatatgaaacacatccatgtcaatattaaaaacatctctcacagattttaatagtctctgtttatttgattgttttgacgacatctctttgatcacaggtccgtcaatttttccaacacctgtaactttattattatcattttttgaggacatagcatcatctgttaatgagcccatagtgtgactgtttgaagctattggaattggttcactgattgaaagtgattttgagaggcgcgcggatgatcttggaggcggcaacttcgcatcactggcagcacccactaatgtattcttaggaaatagtgaataatttgggaatagttcattgaataaaatgggtaaataacttccagttactaaagcactcctttgagaaccaatagtagaatacgctttctggtcgattattggaggttcgtgttggacacttaatttcattattccttcaatgttcaacggaggttgtgataaatgaaatttccagagctgataaacaacgttattaggagaatcattatccctgacgttttctgtcgaattagttttatgtctcgtagagtcgattgcttgtaatctttgttgccatttatgaaaagcgttttttgttctgttaattttcttttccaagtacttgaatttcgtatcagatggtaaatcatcagcatgaattaataaatcgccaaaataagaaatcacgttagctctcgtaaagtcgtcatccagatttggaggagcgagtatgaaaacactacttgtagatttagatgtcctttgtcgcctctctaactgaataatggtaggaacccaatctttaaaaatagttttcaatgactgatcaggaacatatttccatgaagatgaccttagtacaggaattgaacaaatgatagtggcgacagctagccatgataccatgtctcctaaatgttcaaatctacagccaatttggacccatttatctaataactcagctctcacttttggagtcacttttttactaaactcaggatttgttggaaataaatgtgatattagtagccttccaagaaaatggatattttggtcgttgttgaataccaatggatttaacgagacaattcttcgattaataaacttcgaatcatacagcagagaatagtcaaatttcggtgcccatactttatcaaactttaaattgatatgatgaacttcatcagccaatgttgtaatgtctaaagacaggaaatgacttggatccaatataatctctaattcatgtgtagatgatgttgccattggaagagatcgagtgaatgcggtaagtttcattaattcgttatgtttattggcgattttaattttcaaattgttggaaatttcatcgttatgcaaagatatagtatctaataaggaaattatagtcttcagcattggttcatccagcaaaaatcccggaaatacatcaaggattgttttagcagttaaagctaatctttgagtcatggagtcatcgacagcaggggatatgttgtagaattgtgtggaattatttgtcaatcttgatttattcttggtaaaagaaagaccgaattggttgaatacctttagaaacttaatgaaatgatctagtaatggaaacatcaataacagattaataacagctctatgtgtcttagataatgatttctcattaggtacgtccgattgctttggaccggggtaaaataagactgtgtgacataaactttctattgtgcctgatataattttaccatcactgtcttgtcttaaatctgggtgcgggtaaacttcagataaatacttcaggtccagtgtaataggttcacccatttggccaaatgattgcttttggtgcagagcttccgcttgtgcttggttgtttgtttgttgttttttctgttgatggttttcatttgctatactactatttgaagctggtaaagttggatcaaaaaacttaatgttactattcaaaccacttttgtaaaggttgagaacgcaacctttcaattgagccctataaagacggtaatcaggtactagcatttgaggatctatagccatgctgcttcttgctgaggccacatcattgccactgttagtggccgtagtactactgctgtcatcattttttaaagacgaaccgtcgttcccataaaacctgctttccctgtttctagaatacgcatcattacggagattctgagaggaggacgaagaggaagaggaaggggctgtcattgagctattatagtttgtagcaacagtctggccatgggacttattaacccatccagtcttaaaaacagttgtatcatagttttcagagtttaagtggataacatttctttgcttttgctcgttatcgttgttattattgctattgttattattagtgccgctactgttactgatacctgaagtgttcaacgatttctctagcgtagttccagtgctacatcgagactgaggaggtgataaagacgaggaacgtgaaggcaacaatgagtctttcgaatgggcactcttcttgtacgcaatgggagtctcatcctgggcattggacttctggctagaagaattgcttatttcatcttcggagcagacagacggagaatcgtcttttagcgtagaggctatgcttctagaagatctggtgttagtatccgaatgatacatccccaagttcacctgactggaactagtggatgtgtactgcttggagggtggaaatacggagctttttctcttatctctgttgttgtcttcccctctgtggtgactgtgtccctggccatggtgatggtgggaatgcatgtatggagaagcaccgcttgtcgagtttcgaatagtttgagaggatgatgacggcgacgacgacgatgctgtagacgcagtagttgtcttatgagacgtggaagttgagcttgaactagcactggccgttgaagatttcctgttcttagaccagagaagacctttcattagactcctgcttcgttatttgttttttttgtgtctatccagaaaaggcacgacgaccgtgtgttcttttaaactgaaacgtttgcttgtttgttctgttggaaaaaatgggactgatctgcagtctcctaaccaaagagggaaaaaaaagaaagaaaattgcgtatagcgggaacgggagaatacgaaatctgtatattaaaaatgaaaaagaatgtttgagttagcagacagtaccagtggctgcaacgtagcttgcttcttttgtttttgttttttgtgcaacaagagccgtctgatatcttgtgttctcaggtcattttcaagagcgtgtttcaccgaggggaatatgtttcaggattcgcggcgggaagatttttgcttgcattaaagatttacttactatacagaataaatagtggaattgttaaatattattaaatagataagggacctgactgagcgctcgctcccgactaggccaaagacatcttagccagctcatatacagcctctttggacttggcacctccaatgaaacctgctgcatgaatgaagatacatcctggcacaccgctcttggtgctcagctcttcgtctctgaggcctcttaatggctccggcaaacctctcctaaactggaaggaggtggagttgattggtacagtagataccctccaggcaccagaagagtctgtgaagagaacaaactcgatttgcttttcaatgttcttctctctttccagctcgtatagatgctccttccatggacagaattggggcaagacaatgattttgccactcttatcaacatccattctttcatcaatggcttgcgccacaagggccttggctggcaaccacgattgaccgtagcctcttaccaatgtgacaaagaccccaccgataaactcacttgcgcgagcaaagcatctgtcaaaagactcatcggaagtgtcttcgttccagttaggattcatacctgaaataatcccgggaatgctgatggcgttatccctgaaattcggttccaagttggaatccttaggaatcgtgtacttgctaataccgttgtcgtttgcatccagtgcctcgacaaattgtttgtataccttgtcatagagcagatctaaatcagagctgctaaccttgttgttcaaaattgttttgataatgtcacgaccgtagtgtttgaagatcagaccagcacttgagagcttagtcttgtatttctcgttgaaagtttcgaaaaatccacgctggtggtggtcaaaaaatttcacgccgtcatactgagctcctacatccactagaatgtcactagcctcccagtccttgggatttcttgatctaaccaacttagcatctttaaattcgggtagtagccttaacatgtataccgccaacgactcgtccgcgtgaaaagatccggaatgcgtgcatatttgtttggacatttttgaatttagctttactctttttacgctattcatgcagactttttgggctgggctcttcaattccacagcttttcgatagtattaacacatcattactttctacgttgacagaaaattttcgtgatttgccgttcccatcgctcgaaaagaaagtgaaaaactgaaaaaaataatagagatttatcaatgaatacagtaatccaaagacgagagaagagcaggaaaattcgtacttatattgcaacttaatggtgggctcagatttttcgatgctctgcctcgtaactctaagtatcagctgcggatggatcataagtagtattaatatagaatatagaggcgcaaattgaggttaccctgtataacggcagtcgttgcgtccattgttatgtaaagtcttggctttatagacacacaataaatactcccagcatgaattgttttacccaatattgcacgaattatcgacacatccaaagatggcgagaagtagaaagaattcattggttcgagatattgcgtctcatccgactataccagaatctcagaccatagtgggtttactggacgattcgtacctttttgataagctaaaaaagctatctttggctgtggaaaattctgacagtctgcaaagaactgatgtctcagaaggttgttcagaggttaatggttctgaagctacgacttctgcggatgtaaaaaagacaaacaagtatttgtattatactacctatttggaccagttaaacattaagatagacgagtataaagttgttctggatcaaacacgccaggttaacgatcaattggatagttccatcaagaaatttcggaaaatctctcaggatactggagctttcattgaggaaacgaagacgatctatgaaaagcagtctaaattaagcaatctaactgagtcaatccctaaagctctccattattttgaagttttagaccctataatgcgtcgcttgaaccatgccacttctcccgctattgttaagaagagctcctttacgacaatgttggcgactatcgacgagtctttacgttttttggatgagaatagtgacctcaaggatgcggcagcgtacagaatcaagttcaagcaatgcttgatcagagcctgtgaattgatatctcactttttaacgaatctgttgaaacaaacaaatcaagaaattttggataaaaccaaaaacaaaaattcgttaactgggttgccgtcgactacaagagacgccttcttgtacagtaaattctataccatagctgatactttcaaaattcaggtttcggaaattgttaagagaagcaacgaaaaagcctacaacaagtatcacgatgaactgaattccattctttacgagtgtttcaaccactatttccaaacacgtttaagactgctaactccggtcatttggtcacacattgatgaaattgttgttaaagataaggaccagggcttggtcaaattcattcaagacggtaaggtttattttcagcagttatgcgcggacgaatacaaacttttcgtagaatttttccctgaaaaggaatgtcgtttcaagattaatcagtggttcttacagttatgtgaacccctttatgactccattagagtcagggttttgaaagagacagatatttgtactttgtgtgactcagtgactttgtttgctccatattatgaatttgaagaaggttcagaagaatacgtgaagcagtttaccgacattcagtatgataaactattcgaaccgattgtccaaaaagtgcaggctagattaattttaagagtgcaaatatatgtccaacaaaatattttgagctataggcccactagggacgttttcatgatttcaaatagaaggagaaaatcgaagaccagcttacaagggggtaacgaagatgctactactagtgatgacaatccagatcccttgttagaatcttatttatcttctttcaagaatagaagcatattgcccatatcccctaatgatgcagacgataaaagtattgattcagaagaatctactgataaaatttcacagttgcaaacatattatccgcccttgttaaagactttggctttattgtccaaaatttatgaaatgatcaattctgtggtatttgatgatttagctcaccatgtagtccacgactgtattgtatccttgagaaatgcctatgatatggttatcaaatcttcagcgggaaaatctgattttaacaacttagatatttcattagcgtacctaaaaaatttgttgatgttacgtgattccatacagaactttaatattcaatatacagttaatgaaacttatctggatttttctggtgttgaggggtttttcaaatcacttaaagaaaatggtagaaacgttttgaaaaagacaaagtcatcttcaatattgaccctggcaagagagctggttccaaaagttgtaaacaatatggtggacgcccgtacggaactcatatctgaattgagaaacgtcattaaagattttactgaaagcacttctttggagcttattgatgacactttagatatcaatagtgatgaagatctgttaagcaaaaacgtaaaattaagagagaatataaaggccagattaccaagaatatatgaacagatattgaactatatcgatgatcaagagattgttactaatttattagacgctgtgcaagagttaattacacaatcatattccaaatattatgaaactataactgaattggcagaaaatggaaagtttgctaaggatcaagtcgcagacgtaatgtacttggacgtcttcacagatttttttgccaaagaggtggcggatcttttaagaaatggtgatattgataccataacgaaataaacttatgtgtaatttcaactttttctataattttcatgcatacataaatctgatatcgaaataaaaattacattacacggtaaaaaaaatgttttcaaagcttttgatcgtaagcgattgaaaaaatataacgaatactccgatacggggagtcgaaccccggtctccacggtgaaagcgtgatgtgatagccgttacactatatcggattaaattcatgaattttttagggctccgaatattgtaaattcgttaacaattcaagcaactcatttaaacaagtaatcaataaagtcaaaatatataaacaaattaagatcgctgccaaagtagtgatcaaccaagagacattaaggttgttatctcgtggaccacaacgcacctagatgcatgcaaacataacaacagtggaattcatttgttagatttgaatttgccttaacattgcggttcgtaagttttctaggtgacagataccggagaaaggtgaatcgaactgtatcgtaatgtactactacttactcatatttttggttcagtgggatttattgacgttaagctcacttttatcatcctagttcaatgtaaagatttatgagattatttaaagaagttttcaaagtatttgtatgattaatagtgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctagaggagaacttctagtatatctacatacctaatattatagccttaatcacaatggaatcccaacaattacatcaaaatccacattctctacaaatagcccttcaccttacattgcaccactggttgaacagtccatttttaaatctctcccattttgttattggtataatggggcatgtaaacctgtacgagatccccagaaattacgatgtaaatacctacattggtattacagttttttatgtgaattaaaatttatcatcttaagattattaccacagcactatattctgaacattattcgaaatgatataattcaaatattccctatcagtatgtccataggcgataaaaatgtgattaagtaattttcgagcccccgcgttaagcaagcatccatcaataaaaacttcattaacactcttagataatcactgtaaaaaattctaattatcggttaaggttataaagttaggtagctggtaaaaaagcgattgatctcagacatatcttttaaatgttaaaactcatcgctcttcagggaaatcttacgcgctatttttacagtcgcgcgggtcttaaccataattttttaccgctgcaaatatttgaatgctataagagcagataaaaaatagattatagaaattaacctgttaaaacaattatccaaaatgtagtaagtatttatcttacgtaaaaagttcgatgcatataaaataaaatagaatatataaagagatacaacagagtctcaagaaggaaaaaagcttgatgaacccgttataagtagtaatgtgtatacttagcgctatcctggtgaacgcgcatttcctttcttttgaactcattcacctccattttgatttcaatattggatatattttttgtggatgagagattattaccgacaaaagtagaaggattggtaatgtcttggctctttcctttaaagaaattattcaaaaaggtattatcacacctgcaatagtccgcggcggaccacgtatcgtttacataaatctcatccgcaaagcgtaaggatttgacggcatttttagatttcgatgaccctgaagaaggggcaggtgttggcgaagaagatatggattgcattggtccacgggaaaccaacgatgacgaggacgaagaagaaggagccggcgatgatattgaagagtttatgaacgaagagttcgcagcatcagtagtggtagagagagaagatggcacagaagcagtcaaaggcaatttgtttaaatacacggtagaccattcatcctgcaaacgctttaagaaaacggtgctcttttcctctggagcaatatcttcattagacgaatcttgactacagtagtataactttgtagttcgtttatcagacagtgtaggtctgtttggtgacctagggggtggaagaactggtatcctgttattatctccgagtgctgtcaattcttgtactatgccagagtccttaattgaaggtacagccgtttcgtgattgttaacggttgaaaaactctgttttataatttcaaccggttggtcaagggacgttatcggttctggtacaactctctccggatttttccttttctgctttgttttgctattctcttctacggaatctgcagaatttgatgacttggacgaccagattttcctgaagaaacgagatatctttttagaatttgatctaattgcctttggagactcggattcagatttctgattagcatcagcagctttcgtttgttgaggagaacgattgttcgtgccagtggcaatggaatcgttatctgcggaagatgggcctccagtctgggtcaaaggcaacgatgaactagaaggagagtcgggaaaagtcgaagatggcggaagccttgctatctggtttcttggcgtgaaattttcaccgttggggaattgaaaagcgcttttcatctgctttctttgtaattggaaaggagtaagttccttcctaacacgtggattagaataggtaggcggggatgatcggagactgtagcgactaccagagtacttttcgggaatggtcattaaggagtggcgtctggacgggtttggtctacaacgatattgcgggtgcgcattgtgatcactggtagtatggttgttcatgttcatgttcatgttcatgttcatgttcatattcatattcatattcatattcatgttatcgtagcgagaggggcgatttctagttgaaggcagagatgaagtcgaggaggaagcaaagttaggtttattgtactggcgcatcggtgcgccattaccattattgtctgatctattagccaccagagtagagtgcctccttgagacggtagcatccggtatgtagaacagatcaatcgtagacgcagatctagcgtccacagccctaggaatactcaaagagtctctccttgaaggagaagtgagcgtgtgaaaatcattaccatgcaaactcctcctcgaggaagaaccctgctgtaacatgctgattaagagtgagtggaagtagtagcgagcggtggtggctatgtgtttagcctggtaaaatgaatcctattgtgtcagcacggaaaaaacaacaatagcaataatatgacaataaacaagtattttgccgtagctctccttcagttatttgatgatgagtgtaaacagattactgtatatagagcagtagtaaagaaagctgaagtcaagtgcagatgaaagacaaatacaaaaggagtacgcctgtattatatttccaagtgcgtaattttgaggtattaatattaagtaattatcagaagcaagaagccaacaaccagaccgcttgggcttaaactagcatatcagcacaatctgcaagtatacatttctttggtgtctcgaacgcaacgcggtgcaaaccgcgagaaccttaacgatttttcacactccttcctccgttgctgcaagaatcctcgagctagcccttcgtccgcttcctttggcacttgaaagaaaaaattagcttttctttttcctcctttctttttgtctttctggtgtaggcacagttggaaggatgggacacctaaaaatcttatttaagaagtcacagacggtaacgcagcgcctcgtttctaaatcgtatagcaggctgagcgcccgcacacccacctgcgggagttactccggggatcgtatggggtgatgcatgctctttcgtaaaccttaagaatagcgttaattttttcctaaataggaatacacatactcatgctatgtaactgtagagaaaggtacagattacatgaggcgccggttgtcgttgatacatatgtgattacgtttcgtccttgataatagagtataatatatatgtgcagacatatatagatataaatacattggtatatggatatatatagatgtggtattcattttacactaagttacatcgccccgttctgctcaggcactctcttcctccggttgtgtttggccttcttctacgcatagaccttcccttaagaaatcgaatttttcgtcgtttaaaattgttttttttagtatttcggcggttattctcttggttccttgtcctcttgccatctccccgctttttttcaccaataacgctataaaaaactctagggacctgcccgctattacgggcgtggcttgtgaaacttttcctatatcctcgtctgtctgcattattttctttaccttggccggagggaagtgtgtctttattctgtcgaatacatcacctagctcgttgttgttattcgagttggtacccatgttacctactggactccctccagcatcaagtggtacctcatgttcaggttttattggtggtagttgtgttgtaactggtacttgatctgccattaagaatgtagtgatgagtactgtaactggttttatttttttttttgaatttttattttcgtgacgtgcttttttttccgtttttggttttaatgccccaaaataaaataatccccttttgtatacgtttttctttgcctgcctttttatttctcagtgcattgccctttctttcgcaaattcatgtgttttaagggtaataggaaatatcacgctacctgacaaaaaaaaaaaaaattaattttggcctggaaaattcttctccttaaatacaaaaagattcttttttatagaatgtcataattcacgaacagttaaaaaaatataaacacacaacgtaacacagatgccgggttacgatatccgaaaaagttgattaaaagaaaaataatccttccccgccaggacttgaacctggaatcttctggttcgtagccagacgccgtgaccattgggccacgaggaataggatgttcagtgtgttgtattacgggctcgagtaataccggagtgtcttgacaatcctaatataaacagtcttagggaagtaaccagttgtcaaaacagtttatcagattaattcacggaatgttacttatcttatatattatataaaatatgaatcatactaagtggtggaagcgcggaatctcggatctaaactaattgttcaggcatttatacttttgggtagttcagctagggaaggacgggttttgtctcatgttgttcgtttttcaatccttgcgtttcagcttcctctaacatcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctcttagtctcattgctttagtaccaaaaaatctgtttctaaatttctcttcattattggatataattatactgattgtagatttactgtcggttagtaatcctttagtaattggtttcttgttaagttcttgcacaaggtgactgaggttatttaataatgggacagattcacttatcgcgtgtatttctgcttccgtagttgaagtacatgttaatgaagccttggtggactttcctccaattacttttccattaagtaaatatatgttgccaatttgtgatttataatacggttggttaccatacgatgcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtctatatatagacctggttgacctggagcgctaagtttccttccttttgggttcaaaggtacgtttagtttgggtattttttcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtattaacttatcattcattcctaaatgtggtggaggtcttatgtatagttcttctttgatgtctgcatacaaatatgccgaagatatgtctaattgtgtaatatagtagttattgtctaatgcaagtgacagggatgtcattaatgcatagtgatgtacggtattggattgcatgcctgggtcgtaagtgtcaggatgttgaatatcacctcttgcaacaaatctagctttatgagtaccgtcacgtttcctgttaaagataaacattgaatttattactcttttggggtctatttcttttctgtcataatatctgtcagtgtcccaagttttcatcttcaacagttgattgacttctttgtggtatgcctggatatatttttctttttctttaatatctttattataggtgattgcctcatcgtatcgtaaggttgttcgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaaggagtctgataattcggtaggaggttctggaggcagatcggggagtggaagatcagcgataatagattcctctgtattctccttaggacaggtatctgacgttttgataggaacgacgtggtgtagtgaattactttctgatgaggaagtatcgatcgaaggtgaacggtgtatgatccttttctcagtctcctgttcgcttgtctgcggaacagttttattattggtaccacccgtactggatattggtacgtttgtatgattagtctcattgtcactgtacgagtctgagtgtctgaaatctttagatttactggcgtgcgacgactcatgtgtgttagattgggacatgggagcaagtaaaggaacatctaatctatgcataccacccgaaccggtactctcgatatcggaaatttggggggtgctagatctcttcttagatggaagaatattagattcagatatgttggggtcaacttctctgggtgcgcgaatattggttttggaaacacgtttcgaatcttcagtatgagttgacggaggtgtggaatcggttggactcacagcttttgaaaggacatttctcagttgctcaggatgtagttcaatgtcagattggaagtcatggtcagattctatgttaagatcattggattgttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggacggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgtgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaaatcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattaggtatacagaatatactagaagttctcctcgaggatataggaatcctcaaaatgggatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacagttttgttataaggttgtttcatatgtgttttatgaacgtttaggatgacgtattgtcatactgacgtatctcattttgagatacaacacagtgggctaagaatatacaaccgttttagtcaatgtgttgaaatatcatattttaatgcattgctcgaatctcttccttcgacttacttatattgattaagggtatgtatttgatccttccacctggaaaaactgaggaccttacagtgttattaagtgtatgatgtatcactgtcgttgtagtatttctcgggaagtttttcactggcaattggaggttgctagagtttcttttaacgcataccctaaacgcttgtttctattttaatgactacttgaatcctatctaactggtgacacaatttgtttcattttttaatatctcacctaatatatcctaataatatgaacataccatagctcttgtaaagctggtccatatttatgtttagtttccgaatgcttttgtaaggaaacgggttgtggaaaaaaaaaaatacaactacgttgccgcgaatcttgttgaaaaaggtctcaaattaaggcaaaaatgatactggaattgttagtcttgtataatcgatcaactgcaacaaccaagtctttaaattttcagtccgtcttgaaagaatagtgaaggttcatttttatttttacatagtaaagtttatagaattatgggcgatacacaatataaatgttctaacccaactgatgcatatcatcactgtacgtttgaaaatcggacaggcaaactggataaatggaaaacgcaattacaaagggtatgaaaatgaatgtaagaagtgaaacagtgcctcgaaacagttcccaaactctctacgacttcattagtcatttcacgtccatatatcaaaacatatatcaatattccttagcgtatgcccttcttacggcgtctcttctcctcttcatgcttttttaaccaagcttcctcacgtttatcctctaaccttgccatttttcttgccatttcctcctcttccaagatttccatctcatttgcttccatatcatcatcctcaagctcatcgtaatcgtattctgaccgcttcttgcctctattgaacatagcccaaatttcgtcacgatcatatccgggaccattgctgtgtttcgatttgctgtggtaaccttcatcttcatcgtcttctataaaatcatccatatcgttatcttcttcatcatagtcatcctggtatcttgatttctgttttctagattctaacttttcttttaatctcctattaggttgagcaaatccatttgtgggcaagttgagcttgacgggcttgggtgagtctgatgattttatgctattgcctccagaagatactccacgcaatgttgcgccaggggatgctttcttttgtggtctttttgaacttttgaaacctggcttgttaaaatgtgggcgttccttagttacgggttccgatgacttaacttttgggggctgtttctcattattttccgcttgtttcattagctcttcaaatgacatctttttgataggttcaggtttcttccttacaactggcttgagtggcgcatgacttgctccaatagacctcttaaacctaattccaaggccaccttcatcatcgtcattcctttctattttctttttctcagatccagatgaggtgccacgtttccgttttacaccactttttttagccaaagcaccattctttaacagttcctgccgcctcagctccttcaatctttttactgcaggatcttcgtctcttatgtaatttttgggtaacaaggaatactcttcgtcattcttcttgggtaatggatcttgcacttgggcttttgatgcagtcgttgattttcgtatttgggaaagtttggaaagaaaactcataactaaaatatttcactttgaataggactcaagtccctgtccctctcatcaacttttattttcaaattacactagttattttattgtattcatatattaatctgtggcacttgtccatgtgggaatatcttagtcgaacaagaaaaataatcatgttaaacgaaaaagtttgaagccaactaagttctcattcattacaaagtatatacaaaattcctgaacatagaatttctttattaaaaacatactttcctaattattcaaaccgtttcagcctcatttcagtctgattcctctgacatctctagttctttcataaaatccgaataatcctccccgacatcgtcgtctgtagcactttcctccgctttgtcaacagaaacataatctaaactatcttctggctctgaaggttcactatacggccttgcttcgtggtttgctatacctggtaggaacccacctcccataaaagtctccgtattatcgtgattgtccgcaatattctgttccttcgtaacgttaggttcttcctcggcaattttaccatatgtggagttcagcttgctacgaatacgcagttttagcagtaaagtattccaactctccaaagcaccaagcaaatgttccttcctattatcatcctcttgaataaactctattccatcaatagcggtttcaatagcttctctgagccactttgcaacaacaatgccacttaaaactggcttaactgtactgccgcgttcaaacttaaaagaagttacagcaggtgcaaattccacccccaaaaacctagcagctttaattgccacaggattctcaaccaaacaacagttaccaggtatcatcgttggtgcaaaaacttcgatgtttccaaatgtattcttggttatttcaccgctcgcactggctaatggagggatgtataattctgtgtcttcaaagctatataatctttcatcttcttcttctgcttcgcccttaggccttccaactgtcctctttatcacctttttacacctgctaccagtttttaaaattcggccgttcatgtaccattgtctagcacttttcaaatccgcaatatctctttttgcataaactttcaaaaccttcccaacttttccatgtacttttaaatatccacactctttacatcctggctttacaatttgagtctgtttgatatcttgttctaaaacataatatgggtggtttttcaaatcctgcaccgaatctggtatgccttcactttcatctctctgaaaaaaatattgatcttcgtaatcatcaattttggttctctttctatggtgaagtgctgttatcacttttctgaaccatttctcaccaaagtcatctttagtaattcttctttttcttactttagagttcatccattgggcatatcttcgagttacatctctacagccatacttccgatcgtaagcaatcacgtacctcaacatatttctttcgcagcacgccacgcctttcggtgccaacttggaatgaagtctgacctgttcaatggttttgagatttactgggtcaacagttatccatttcttagagaatttgtcccacacttcacaccaaaaaatcggatacttgaccatatctttgtacgcattgtttccattcaaagaagtgtcaatcttcatattggtaaaatctggcggttgacatgacatgataagtcgtgcgttaacattacaagccctgagcatcgcaacgaaaccttgcactgaaatatcaggatctccgtgacctttactgacggcccttaaaaagtcagatcttttcaacgtcttgaattttcttttgttattggcgctcatttcaatttctttccaggttctcatataaagtccctcattatcatattttttagtgatcttccagtgtttttgccataactccatgcatttcttcaacccatctaataatttcctagtactcctaagtgggagttcctcatctttctgaggatgcagtagctcaaacactttctcaggaactaagttgctcagttttctagacaagcgcttgctgttaatccattcatttcgtataaatccatgaaccatcaagcaaactagatacaacatgtggaaatattttctccttttccgttcttcattagaacaaacgttgcggcttgtccttctagcatcactattccttttactagagggcttaatttcaacagatatatcttctacaccggccacctcatttccatctgtcacgtcttcaaattcctccgaatcataatcttcttcagatgactggatttcctctacactatcatccgtcggtaccgtaacgacgccatcatctgaagaatctaagtttacagtaacaacgctttctcgtggcaattcattcaaccctgttttaaacttcttcttggcatctggtaggggctggttcttccttctgactcttcttcttctactcaggggcgctttttctgcctctttctcgttaagagccttccttattagttcaaaatattccttgggcaggtcttcattcattttagcggaaaaatagtgtcgttatgtctctgcttgtcgtcctgtttgaactgcataaaatttgcatatattgtgcatgcattaaaggtacttaaccgcatttttccattttccgccgcactatatagatggtagaaaagcaagaggagaaccttacatagttaatcaagatatgtatacatatttcattcacctgtatttatttacagtctccaatagagcagtcagataatgatcggtaatacgccctcgctctttcatgatgggcatttgcgctagcgcttgctccagttttgcaaggtattcatagttagatccactaggtccatgcgacacggcaattactttcgcagtttcatccacggtctctggtccgacgaaggcctcattatctattgtaccaatgtacaccgaagtaagtagtacccgtttacccgatttgttgtgccgaggcaactgttctaatgcttcacccaattctgcctcgtgctcccgattagtttctagatgcacctcaacctcatgtagagtgtacccgttttgttctcttacgttcaaatactctctaacctcttgagcatgttctggtggtatataatacactacccctatggtgactaagtcgtcgggatcctggataggtgcactttcactatacaaattcacattcttcaagaaggcagtttgccttataatatcctcatacgggattagtgtggccactcttcctgggtttgcaggtgtacccctatgatcagtggaactttgccagaaccgacgagcaaaaccgtgaattattgccggtattctatgcgtgtaatgagacggaggcttgtaaatcagagatccgtagcctaggacccagataccactgttgtcattagtcatttggccatacaactttttataagcccaaaccaacgtcgtgattgcttcttccaaggttaaatcacctcgagactaaactcatagctaatattgaccttaccttttagcgttacccagaataccaattatcccgctccttggcgaatccaaaaaaaaaaaaaaggaaaaattactggagtggcaaattttctcattctcttcatataaaccactagggaggacgtcgaagaaaagtctgctaggtgttggtgacaacttccaagcttcccttaacacaagggaactattgataaccgctggttgacatacgcctttaaaagaggtcatacgttgcgacactctctccctcccctctcactgatgttttctgtcttcaatttctggcaataatcttaagacgaagcagtcaagtcctaaggaagaaaacgatttttgattgttttaagttgccactacgtagtggtcaatatggaagcctctgcgcaatggagaaacacgggtggcataggtcagcgaaccatacaagcgagaacactctcattactttatggatcatctcagtatttcaccgttcgaggaaaatcttctttcgcaggccgaagtcaccgtgatatatttgatacttttgagatatccttgaaaggtaagcttctatgttgtacgtttattttttttaactttctttgttttagcttttacttcgatgatatgttactgccccatatacggtaaaagatcatacgttgccaaaatcaaaagacatgattgcctgtatgttttcctcagcccatcaatgcgtaatacggtcagctaaacgctgctcacaagccaagggcttgcgtgttgctcgcgcatcggttggatatcactggtaggccacttcttcaatattttgaaaatgaaacacgctaaagttgaaaacttaattatcaaccgtccagaaggtgtaggcaatttcatctaagagaataaatttaacatcccacgatccttatcacatcccatccctacactaggacatatgttcccaaacattacaaagttctttcctgatatcattactgatataagattatgtcaattattgataccattaaagacatgtaatatgcaacacttgtcgaacagatcatagttcagtagtcgattatcatactgttaccctctcgttatataattttactttttttcctttccttcttttcaatttcgaaactgtaccacgagaaacattgtgtagaagaatcttgtcctcattatatctggttagtactatcgtattcttgtccggacatctaagtcaagttgataaaagtttggggttatcaagtcaagataagcaagcttgcagaagtcaccttctcttttccgttacttcttttgtgaatatacacatacttgtttcttccaaaggagaaaattgaataagcctaaacatcgaccatcattttctttaattcgtacttgagttccactagcttacctattcactaacgacaaagtttctcaaaggtttttatttttcatttgcttcaagacttttccgttatttctttaaacctatacccaattcaaagcagaaccttttctaatttaattctcacttataatggcagccaaggatatttctactgaagtgctgcaaaatcctgaactatatgggctgaggcggtcacatagagctgctgcgcatcaacaaaactacttcaacgatagcgatgatgaggacgatgaagataatattaaacagtcgaggaggaagagaatgaccacgattgaagacgacgaagacgaatttgaagatgaagaaggcgaagaagattctggagaggacgaagatgaggaagattttgaagaagatgatgattattatggctctcctataaaacaaaatcgatcaaaaccgaaatcaagaacaaaatcaaagtctaaatctaagccaaaatctcaatctgaaaagcaatctacagtgaaaataccaacaaggttttctaatcgtcaaaacaaaacggtaaattataacatcgattatagcgatgatgacctcttagaatctgaagatgactatggttccgaggaggctttatcagaggaaaatgtgcatgaagcatctgccaatcctcaaccagaggacttccacggtattgatattgttatcaatcacagactaaagacatctttggaagaaggaaaggtcttggaaaagactgttcctgacctcaataactgcaaggaaaattatgaattcttaatcaaatggacagatgaatctcatctccacaatacctgggaaacttatgaatccattggccaagtccgtggattgaagaggttggacaactattgtaagcaattcatcatcgaagatcaacaagtaagattagatccatacgttaccgccgaagatatagagatcatggacatggaacgtgaacgtaggcttgatgaatttgaggagttccacgtgccagaaaggattattgatagccaacgtgcttcgttggaagacggcacctcacaattacagtatttagttaaatggcgtcgtctaaattacgacgaggctacttgggagaatgccacagatatcgtgaaattggcacctgaacaagtgaaacattttcaaaacagagaaaactctaagatcctcccacaatattccagtaattatacttcacagagaccgcgttttgagaagttaagcgtgcaacctccgttcattaaaggtggggaattaagagattttcaactaactggtattaattggatggcatttttgtggtccaaaggtgataatggtatactggcagatgagatgggcctgggaaaaacggtccagactgtcgcctttatcagttggctgatatttgctcgtagacaaaacggacctcacatcattgtcgttcctttatcgacaatgcctgcctggttggatacttttgagaaatgggcgcctgatttgaattgtatatgctatatgggcaaccaaaaatcaagagataccattcgagaatatgaattttacaccaatccaagggcaaaagggaaaaaaacaatgaaatttaatgttttattaacaacatacgagtacatcttaaaggatcgtgctgaattaggaagtataaaatggcaatttatggccgttgacgaagctcatagactaaaaaatgctgaatcatccctttatgaatcattaaacagtttcaaggtcgccaaccgtatgttaatcacaggcacacctcttcagaataatattaaagagttagctgcgttggttaatttcctaatgcccggaaggtttacgattgatcaggagattgattttgaaaaccaagatgaagagcaagaagaatatattcatgatttacaccgaagaatacagccttttattcttcgtcggttgaagaaagacgtagaaaaatcacttccatcaaagacagagcgtattttaagagttgaattgtccgacgtacagactgagtactataaaaatattctgactaaaaactactctgctttaactgctggagctaaagggggtcatttctctttactgaatattatgaacgagttgaaaaaggcatcgaaccatccatatctcttcgataatgctgaagagcgcgtcttacagaaatttggggatggtaaaatgactcgagaaaacgtactaagaggtttgatcatgtcttcgggtaagatggttcttttagaccaattattgaccagattgaagaaagatgggcaccgcgtgttgattttttcacaaatggtcagaatgcttgacattttaggcgactatttatccattaaaggtattaacttccaaaggttagatggtacagtaccatctgctcaaagaaggatatctattgatcatttcaactctccggattcaaacgacttcgtatttttactttctactcgtgctggtggtttgggtatcaacttaatgaccgccgataccgttgtgatttttgattccgattggaatccgcaagccgatttacaagcaatggctagagctcatcgtattggccaaaaaaatcacgttatggtgtataggttggtttcaaaagacacagtagaggaagaggtattagaaagagcacggaagaaaatgattctggaatatgctattatttctcttggagtgacagatggtaacaaatacactaagaagaatgaaccaaatgccggtgaattatcggcaatcctgaagttcggtgcaggcaatatgttcactgccacagacaaccagaaaaaattggaggatcttaacttggatgatgttttgaatcatgcagaggatcacgttactactccagacttaggagagtcgcatcttggcggtgaagagtttttgaagcaattcgaagtgactgattataaagctgatatagattgggatgatatcattccagaagaagaactaaaaaaactccaagatgaagagcagaaacgcaaggatgaagaatatgttaaagaacaacttgaaatgatgaatagaagggataacgccctaaaaaaaataaaaaacagtgttaatggtgatgggaccgccgcaaactcagattctgacgacgatagtacttccagatcttctagaagaagagcaagagctaatgacatggactctattggtgaatcggaggtgagagctttgtataaagctattttaaaatttggcaacctaaaggagattttggacgagttgattgcagatggaaccctgccggtcaaatcatttgaaaaatacggtgaaacttacgatgaaatgatggaagcagctaaagactgtgtacacgaggaagagaaaaatagaaaagaaatcttggagaaacttgagaagcatgctaccgcctatagagcaaagctaaaaagcggtgaaataaaagcagagaaccaaccaaaggataatccgttgactagattatctttaaaaaaaagagaaaagaaagccgtccttttcaactttaaaggtgttaaatctttaaacgccgaatctttactaagtagagtggaggatttaaagtacttgaagaacttgataaattcaaactacaaagatgatccattaaagtttagcctaggcaacaacacacctaagcctgtacagaattggtcatctaattggacgaaagaggaagatgagaagctattgattggtgttttcaaatatggatatggttcctggacacaaataagagacgatccatttctaggcattactgataaaatattcttgaatgaagttcacaatccggtagcaaaaaagtcggcaagctcctctgatacaacaccaacaccctcaaagaaaggaaagggaataacgggttcttcaaaaaaagtacctggtgccattcacttgggcagaagagttgattatctattatccttcttaagaggaggcctaaatacaaagagtcccagtgctgacataggctcgaaaaaactccctactggtccttccaaaaagagacaaagaaaacctgctaatcacagcaaatccatgactccagaaattacaagttctgagcctgcaaatggcccgccaagcaaacgtatgaaagccctcccaaaaggtcctgccgccttaataaataacacgagattgtctccaaacagccccacgcccccattaaagtccaaggtttccagagataatggtacaaggcaatcaagcaaccccagtagcggcagcgctcacgaaaaagaatatgacagcatggatgaagaagactgtcgacacacaatgagtgcaatacgtacttctttgaagcgacttagaagaggcggcaaaagtcttgatcgtaaggaatgggccaaaattttgaagaccgaattaactacgattggtaatcatatcgaatcgcaaaagggctcatcgagaaaggcaagcccagaaaaatatcgcaagcacctttggtcttacagtgccaacttttggcctgccgacgttaagagtacaaagctgatggcaatgtacgacaagataacagagtctcaaaagaagtgaaacaatttttcttcaccacattttccattgttccttccccccataactataaacgtatttatgtatatatatttgcgtgtaagtgtgtgtactatagggcaccgtaaagtaataatgcttaattagttactactatgaccatataagaggtcatactgtatgaagccacaaagcagatagatcaatcatgtttaacgaaaactgttaatcgaagattatttctttttttttttctctttcctttttacaaagaaaattttttttgcgctttttgccatcaccatcgcaagttctgggacaattgttctctttcgctccagttccaaggaaagaggtttctgttttacttaatagaaagtgtcatcttgtattttatatctcttctttcttgtgtaaaattctttagttttgattttgtatttttaggacagtgagctacgaagtaacatttttacttaataaccgtttgaagcatagagcaggccctggtaccaccacctaatatctggctttttattcaataaaaactcaaaaaaaaaaatccaaaaaaaactaaaaaaccaataaaaataaaatggctgatattactgataagacagctgaacaattggaaaacttgaatattcaagatgaccaaaagcaagccgccactggttcagaaagccaatctgttgaaaactcttctgcatcattatatgttggtgacttagaaccttctgtttccgaagcccacttatatgatatcttctctccaatcggttcagtctcctccattcgtgtctgtcgtgatgccatcactaagacctctttgggctatgcttatgttaactttaacgaccatgaagccggcagaaaagcaattgagcaattgaactacactccaatcaagggtagattatgccgtattatgtggtctcaacgtgacccatcattgagaaagaagggttctggtaacatctttatcaagaacttgcaccctgatattgacaacaaggctttgtatgacactttctctgtgtttggtgacatcttgtccagcaagattgccaccgacgaaaacggaaaatccaagggttttgggtttgttcacttcgaagaagaaggtgctgccaaggaagctattgatgctttgaatggtatgctgttgaacggtcaagaaatttatgttgctcctcacttgtccagaaaggaacgtgactctcaattggaagagactaaggcacattacactaacctttatgtgaaaaacatcaactccgaaactactgacgaacaattccaagaattgtttgccaaatttggtccaattgtttctgcctctttggaaaaggatgctgatggaaaattgaagggtttcgggtttgttaactacgaaaagcatgaagacgctgtgaaagctgttgaagctttgaatgactctgaactaaatggagaaaagttatacgttggtcgtgcccaaaagaagaatgaacgtatgcatgtcttgaagaagcaatacgaagcttacagattggaaaaaatggccaagtaccaaggtgttaatttgtttgttaagaacttagatgacagcgttgatgacgaaaagttggaagaagaatttgctccatatggtactatcacttctgcaaaggttatgagaaccgaaaacggtaagtctaagggttttggttttgtttgtttctcaactccagaggaagctactaaggccattacagaaaagaaccaacaaattgttgctggtaagccattatacgttgccattgctcaaagaaaagacgtaagacgttctcaattggctcaacaaatccaagccagaaatcaaatgagataccagcaagctactgctgccgctgccgccgccgctgccggtatgccaggtcaattcatgcctccaatgttctatggtgttatgccaccaagaggtgttccattcaacggtccaaacccacaacaaatgaacccaatgggcggtatgccaaagaacggcatgccacctcaatttagaaatggtccggtttacggcgtccccccacaaggtggtttcccaagaaatgccaacgataacaaccaattttatcaacaaaagcaaagacaagctttgggtgaacaattatacaagaaggtttctgctaagacttcaaatgaagaagcagctggtaaaattactggtatgattttggatttgccacctcaagaggtcttcccattgttggaaagtgatgaattgttcgaacaacactacaaagaagcttctgctgcctatgagtctttcaaaaaggagcaagaacaacaaactgagcaagcttaatgctctatgtaatcacctacttccctactcaacaaacttatcatcttttttttctcccttcccttttttttttgtcttaaatactagttattatcctttgtaacctaaatactcgctcttattgacaaaatgcaaacgttttttgtttttaactgtcaagagaagtatcattttactattattagacttcattactgagtttattagttgcgtttttttgaggtctcattattaacggcagaatgttagttttcgcggaaaataaacaaaatagcacggaaaaaagaccaacaggttccaggaaaatactaatttacaaaaaattgacaaatcaagtgagggtaccttgctattcatcaccgcattcaactaactggaggtacaaagctgataaaatttcacagagcaaagtctcacttagcttttactttatgaaatttgacctttaataaccgaaggtcatcgtaatacgcaactcagacagttttaagtggatttttagggtcgcaattaaaaacactcaaaaattaaccggaggttgagcaagggaaagcaaccgtaacagaaatcctttatttcctcctggaagtgaaataaaaacgcagttaactttaaaaaggaaagttagttgataattatgtctggaacttttcatggcgatgggcatgctcccatgtcgccctttgaagatacatttcaatttgaagataatagcagtaatgaagatacacatattgcacctacccattttgatgatggtgcaacaagcaacaaatacagccggccacaggtcagcttcaatgatgaaacacccaaaaataaacgtgaagatgcagaagaattcacatttaacgatgacacagaatatgacaatcattcctttcagccaacaccgaaacttaataatggatctgggacgtttgatgatgtggaattagacaatgatagtggtgaaccgcacactaactacgatggtatgaaaagattccggatgggtacaaaaaggaataaaaaaggaaacccaataatgggaagatctaagaccttgaaatgggctaggaagaacattccaaacccatttgaagactttacgaaggatgatattgaccctggtgccataaatcgtgcgcaagaactaaggactgtgtattacaatatgcccttaccaaaagatatgatagatgaagaaggcaaccccattatgcagtatcctcgtaataaaatcagaactaccaaatataccccgttaacattcttaccaaaaaacattctatttcagtttcataatttcgccaacgtttatttcttagttttaataattttaggtgcatttcaaatttttggtgtcacgaaccctggtttaagtgcggttccgttagttgtcattgttataatcactgcgatcaaggatgctattgaagactcaagaagaaccgtcctagatttagaggtgaataataccaagacacatattttagaaggtgttgagaacgaaaatgtctcaaccgataatatttcattgtggagaaggtttaagaaagcaaactctagactccttttcaagtttatacaatattgtaaagaacatttaactgaagagggcaaaaagaagagaatgcagagaaagcgtcatgaactaagagtacaaaaaactgttggaacgagtggacccagatcctctctagactccattgacagttacagagtatctgcagattatggccgtccttcattggattatgataatttggaacaaggggccggtgaagccaatatagttgatagatccctaccacccagaactgattgtaaatttgccaagaattattggaaaggtgtcaaggttggtgatattgttcgtatccataacaatgatgaaatccctgctgacattatcttactttcaacgtcggatacagatggtgcctgctacgtagaaactaaaaatttggatggtgaaacaaacttaaaggtacgccaatccttgaagtgtaccaatactataagaacgtcaaaagatattgctagaacaaaattctggatcgaaagtgaagggccccactcaaatttgtacacttatcaaggtaatatgaaatggagaaatcttgcagatggcgagatacgaaatgagccaattactattaataacgttctgcttcgtggttgcactcttagaaatactaagtgggcaatgggtgttgtaatgtttaccggtggtgacacaaaaatcatgttaaactctggcattacacccaccaagaagtccaggatttcaagagaactaaacttctctgtggtgataaatttcgtgctacttttcatcttatgttttgtttctggtattgcaaatggtgtatattacgacaaaaaaggcagatcacggttttcctatgaatttggaacaattgctgggtcagcggcgacaaacggtttcgtctcattttgggttgctgttattctttaccaatctttagtcccaatctctttgtacatttctgtggagatcatcaaaactgcacaagcggccttcatttacggagacgttttactctacaatgccaaattggattatccttgtacaccaaaatcctggaatatttctgacgatttaggtcaagtggaatatatattttctgataaaacaggtacattaactcaaaatgtaatggagtttaaaaaatgtactatcaatggtgtttcatatggaagagcttacaccgaagcgttagcgggattaagaaaaagacaaggtatcgacgtcgaaaccgaaggtaggcgtgagaaggccgaaattgccaaggatagggatacaatgatcgatgaactgagagctttatcaggaaattcacaattttatcccgaagaagttacctttgtatcaaaggagttcgttcgcgatttgaaaggggctagtggtgaagtacaacaaagatgctgtgagcactttatgttagcattagctttatgtcactccgtccttgtagaagcaaacccggacaatccaaaaaaactggatttaaaagctcaatctccagacgaagcagcgttagtagccacagctagagatgtaggattcagttttgttggaaaaaccaaaaaagggttgataattgaaatgcaaggtattcaaaaagaatttgagattctaaatattttggagtttaattcatcgagaaaaagaatgtcctgtattgtcaaaattccgggtctgaacccaggggacgagcctagagcacttttaatttgtaaaggtgcagattccattatatactcaagattaagtcgccagagtggtagcaatagtgaagctattttggaaaaaactgctttgcatttagagcagtacgctactgaaggtttaagaacgttatgcatagctcaaagggagttaagttggtctgaatacgaaaaatggaacgaaaagtacgatattgctgctgcatcattagcaaacagagaggatgaattagaagttgttgcagattccattgaacgcgaattgatattattgggcggtacagctatcgaagatcgtttacaagatggtgttccggattgtatagagttgcttgcagaggcaggaattaaattatgggttcttacgggtgataaagttgaaacagctataaacattggattttcttgcaaccttttgaataatgaaatggaattgttagttattaaaacaactggtgatgacgtgaaagaattcggatcagaaccaagtgaaattgtggatgctttactctccaaatacttgaaggagtatttcaacttaaccggttcagaagaagagatttttgaagctaaaaaggatcacgaatttccgaagggtaattacgccatcgttatcgatggtgatgctttgaaattggcgctatatggtgaagatataagaagaaagtttcttttactctgcaagaattgtagagctgtcttatgctgtagagtatctccatctcaaaaagcagccgttgttaagttagtcaaggattctctagatgtcatgacactagccatcggcgatggttccaacgacgtcgccatgattcaatctgcggatgttggtattggtattgccggtgaagaaggtcgacaagctgttatgtgctcagactacgccattggacaattcagatatttggctagattggtcctcgttcacggtaggtggtcttataagagactggcagaaatgattcctgagtttttttacaaaaacatgatttttgctttggcattgttctggtatggtatctataatgattttgatgggtcttacctgtatgaatacacatacatgatgttctataatttggcatttacatccctaccagtcatcttcttaggtattctggaccaggacgtgaatgacacaatatcattagtggtccctcagttataccgtgttggaattttaaggaaagaatggaaccaaagaaagttcttatggtatatgttggacggattatatcagtctattatctgtttttttttcccttacttggtttatcacaaaaatatgatagttacgagcaatgggttaggattggatcatcgttattttgtcggtgtttatgtgaccactattgctgtaatttcgtgtaacacatatgttttattacaccaatatagatgggattggtttagtggattattcattgcactgtcttgcctcgtagtttttgcatggacgggaatatggtcttctgcgatagctagtagagaatttttcaaagctgcagcgcgtatctatggagcaccttcattttgggctgttttctttgttgccgtgctgttctgcttactgccccgtttcacatatgacagttttcaaaaatttttctacccaactgatgtggaaatagtaagagagatgtggcaacatggccatttcgatcattatcctcctggttacgatccaacagatcccaacagacccaaggtcacaaaagctgggcaacacggagagaagattatagaaggcatagcactttccgacaacttaggaggatcgaactattcaagggatagtgttgtcacagaggagattccaatgactttcatgcacggtgaagatggaagtcctagcggatatcagaagcaagaaacctggatgacttcacccaaggaaacacaagatcttcttcaatcgccccaatttcagcaggcccaaacgttcggaagaggcccatcaaccaacgtcaggtcatccttggaccgcacaagagaacagatgatcgccactaaccaactagataaccgctactctgtggaaagagcgagaacatctctagatctaccaggcgtaactaacgcagcctccttaatcggaacacaacagaacaattaataatgatatccgaaccatagctgatggaactccgcttttcactgtatatataatattacataatattactggataagccttagaagccttagaagccttagaagccttggaattcatgcatactacagcgttaactctttcttttagcaagttttagtagcggacgtgtgggtttctttgttctataattaacactcccggttaacccggatcgctattattcaaggacgcacaatggtgggctaattttttcttccgatggaaaactgacgccagcactttccagcgctgggaactctccactaactggcaaaaaaattgattaaggtcatgatcaaaggaatttttgaaatgttgtaaagtagagttaagaattaatcaagccgtgatacgtatgtttttgactaggtgagagactatatttatcaaaaatagttttttatactaacagaaagtttattatatcatagaaatcctaggcctattgttattatttgcgtgaaaaaaggttcatgcctagttattcaggatattaatcaggcatagtcatagttttgtaatacacgtctttcactcctatttccggttaacattcgctaatatccatcaaattattgacttttttttcagtggatttgttgttaataaaggaaacaatcagatcagccatttagggaagtcttttaagaaagctcagaaggagatctaagacaagaagcaaggcagtcttgatttatcgctcaaaaccaatagcacatgccgaagaatagtcaccaccatcgttccagttcggttaattccacaaagagtcgttctacggaatctacgaataaatggaaaattccgcactattatcgcagatccgctagcggcagcacacaagcttcgccggacaggaactcctcaacaggctcatgtagcactccagtattacctactatgaatgttatgtctagcccgaaaaaagttttgctagaggatcccagagacaaccatactaaggcgaagaagagtagtagaaagaaatcaggtgaaatggtcttcgtcaattatactgtacaggacacggctaacgaaaatgatactgacttgcaaacccagccggtttctgtgccagcaccaaaggcgaaattaaagaagaaatcctccaaaaggagaatgctgaagatatttggatcgtcaaagaacgaacacatagaggacatcgttgaagagcaaccaatggtgcttcaaatggattcagaatctaaacccctttcgggaacccctatctcagaaagcggaatcgacgcctcgtcactaacaaccaaaagatcttataactcgttcttaaaacacaataggctaaacggtaaaactccgttctctggaaacttgtcctttccatcattaaacatgatgggtaacactactgatctgcctattgacaataacgatttttgttccgagaaagaagtcgttccgaaatcaactcatgatccttcactagcaaaaccgccatcaaggttcactgaaagcgaaacaaattctactcccaacttatcaagtatacctctcatgaacacaaaaaatacaagattgaagtacaataaagtggcgcctcagagttcagaccgacaaaagtcacaggaaagtgggctatatcattctaccgaatcattcaacttcaaagatcaaaactacagtaacaataaatcctctttaagtctgaactccgatttaagtacaccccactttgcaaagcattcacctgattcaccaagaacttcaagatctttcaactgcggagactcacaaagtaaagttaaattaccggaagaaaatgacgcttctattgcatttagtaagatgtttactagaaaacgagccaacactggcgggtccacgtgttcgctagcctcacccactattgcacaaactattcagcaatcaaatataaaagttaataaattgccaactcagcgaaccacttcagttggctcattatcatccatgtcaaatcgttattcaccaataagagttgcatcgccaggaagagcaagatccgcaactcgtgggtcttccctttatagattatccagagaccttaattctttaccaagcgtcactgatctaccagaaatggatagtacaaccccagttaacgaaatattcttggatggccaaccacagcataaaagtggcagtgtcaaaggagggcataggaagaaacaagaatctatctctgatgctcaaagaattcaacattctaattcgtacattacaacaccttcatcttctctggtgactcctccttactacatgacaggttacacattaccaagttctgcatctgcttcttcaactccaaatgtgcttgaaacacacaatatgaactttgttccaagtaccagtactgttacaagttatcgcccatctagcaatttttcctcatttgacaaagaatacagtaacgaaaacgacgctagtggggaattctctgctttcaatactccaatggagaatataccggcactaaaaggtatacctagatccacgttagaagaaaatgaagaagaggatgtcctagtacaagatattccgaatacggcacacttccaaagaagggatattatggggatggatactcacagaaaggatgacagtttagattttaactctttgatgccacacggtagtacaactagtagcagcatcgtagattctgttatgacgaactcaatatccactacaacaagcaacgcgaccggaaactactttcaagatcaagataagtatacattggtaaatacgggattgggattgagtgatgcaaacctcgatcattttattagatctcaatggaaacacgcttctcgatcagaatccaataataataccggaaatcgcgtttcttacagtggctcaacaccaaacaatgttgatacaacaaagactaatttgcaagtgtataccgagttcgattttgaaaacccagagtcgtttttccatgagcaatcgaagctactaggtgagatgggccacagcaataacaacagcaacagcgccatcaacatgaatgaacccaagtctgcggatacatacattggaaatatatctccggatacttcagcaactgtttcattaggcgacctgatgggctcaaacgtttcaaacaacagtgaaagaaatttttacgatggtcatactttcgttccacagtatcaggcgaactcatctgtggaaaactcaaataatcaaaatgcagcaccaattgcaaataacgacattgataataatttacagtctttttattttgataatagcaactaaaaaaggaatgaaaaaaaaaaaaaaaagttcaaaaatagtaacagatatctttcgaaaaagttaaaaactggtaaaaaattttgaatagagtatataaaaactaataaatatgtttagttatcatacaccatagaataactactagagatattatttcattttcgttttcattttttttatttttttcttttcaataaggtaacagaaagttatttatgcattcttgttctacatgtcttatgtatactaataagctactacaggtattttggtagtatggcttttaaatgagttattaattcttgatcagtccctgtaggattatcaaactgccacctaatcgcttcgttattaattttacccagccatggacctggcttcatttgaagtagttttgccatttgttttccgtccactattggttttagttcatgacaattattcaaattattgtcaaatatgtaagaataaaattcattgtaattttggaaaagtaattcaatttttttagtttcaagcttgggaatctttaaaaatgcatctgatagagatgcaaaatgtgctgtttcccattcgccattaaagttccgtagaaatataccgatttcggatttttttagctgggaacgatctgcaaacttagcaagtatttcctcatatgaacatattgaatctacggtcttggcaataactgctgcatcatttttactcagcttcaatccttccttcacaatgctttctgtcaccgaaaccaggttgttaattttcttctttgggttcccgattatttgtaaattagccatgggggacaggatcgcactcaatataaaattttgctgaaatcctggcgaacgaccaattttttcccttaagataggaagcttctctaaaaacattggatataattcaataaaacttttcaagtgtgagtttagtatgttatcattgtatacatgattaattttgtccatatcttgacaattctcttcgttgaattttacgacggagctatcattatgccaaaaaaagataacattttcaagatgagccctttgaatcagctgcaaagccaataaaggggttggtcctactaatattttctccatctccacaccaactcgctctctagaaatttttgaattgaatgcaacattaatctgaggatcgcccatttcagccatcacttccggatctatggtaaagttgaatctagaagcaaaacggatcaacctcaaaaccctcaagggatcatccaaaaatgtttgttttgcaggaagcggagtacggagaacgccatcttttagatcttgcagacctctcttggtgaaatcttccacttcacctttatgaatgttatagaaaagagcgttcaatgtagcatcccttcttaaagcgtcttcctcgggtgtgccaaagcacactttaggtatcctggaaagttcagtatacttttcagatcttaaattgacaaaatccacttcaacgccaaagagcttagtagtggcagtttccagatgcttggatttctcgggattcttgtcaatcttgtggatattatgaggcttggctccatatttggcgtaatgttgttgcaaatactcgttcaaaccagtagcaaattgctcacctgacatcacattgatggcaatatccaagtcgtgagaaccttgtcccagaagcttgtcacgcacccatccgcccgtgatccgaagagtcaatggctcaggcttattgtggtacttttgattgtacaagtctgtataatcgttcagcaagttacagatgttctgttccactttggttaaggtgattttgggtgcatttagaacaaaattagaattcgtcatcgttttctgagcagcactattcatcagtagagatatagtagaccgtagcatacacaaaaaaagcccttataacccacggatacgaattaatctcgagggaagcgttgcgatgtattatgtagtttcctttagtacattgttaatatggtagatttttgcgattcatttttcaacttttcaaccctaacgaatgttttttagggctgagtaacgacaagaacacaaccctaaaaatcagatgacctaagggtttggtgaatcgagaaagtatgccctatttcccccgcccatacaccccataagccttaaccgcagccctcctctcccctaaacgtttctttttctttttccattttttttttttttttagttttactttctttttattcggaaaaatcttttctatatttttcaagggtaacctcatcgccatgcaattaatcacatagactccttaagtaacaatggcaaggcgataattttaagagaattgcagacgctgtacatagatcgttatcagcaaaacatatattcgcatcgaaggcgttgcttgtccctgaagtagctacttgcggttttcatcaagcggccaatttaatcattctatcagcattattttaaaatagggggacttaacctttctattagtaccacttattttatagatctgctggagaaaaataaacagataaaaaaaagggaaaaaaagaataagactgtcttggtgaggatattcagttgcgtgaaatcatgacgaaactaatcgctccttcagaaatcgtgggcggagtgcccgtcttcaaacccacatacgagcaattcgaagatttctatgcatactgcaaggccataaacaaatatggcatgaaaagtggtgttgtgaaagtaatcccacctaaagaatggaaagacaaattagatctgccttattctgcggaaacgctccaaaagatcaagattaaatcacctattcagcagcatatttctggtaataaaggtctttttatggtgcagaacgtggagaaaaacaagacctataacattatacagtggaaagatctttctaaggactatgtgcctccggaggatcctaaagcaagacgtaattctaggaaaggctccgtttccaaatccacgaagttgaaactgaaaaattttgaatcgtcttttaatattgatgattttgaacagttcaggacggagtatacaatagatttatctgacttccaaaatacggagagattaaagttcttggaagagtattattggaaaacgctaaattttactacgcctatgtacggcgcagatacaccaggatcaatctttcctgaagggctgaacgtttggaatgttgccaaactaccgaacatcttggaccatatggaaacaaaggttcctggggtgaatgactcctatctatacgctggtctatggaaggcttctttttcttggcacttggaagatcaggacctgtattccataaattatattcatttcggtgccccaaaacagtggtattcgataccgcaagaggataggttcaaattctacaaattcatgcaggagcaatttcccgaagaagccaaaaattgtcctgaatttttaagacataaaatgtttttggcttcgcccaaactgctgcaggaaaatggcatacgatgcaatgaaattgtccaccatgaaggcgaattcatgatcacttatccctatggttaccatgcagggttcaattatggatataacttggcagaatccgtcaactttgctttggaggagtggctaccgattgggaagaaagctggaaaatgccactgcatttcagactcagtggaaatagatgttaagaaactcgctaaatcttggagggacaataataaagagtcgaaaggaacgccacccctcaatcaattacccaatcctgccatgcccttacttcacaggccaactttaaaagaaatggaaagcagctcgcttagatctacaagcccagatgtgggtcatttttcaaactttaaatccaagagctctggtgtttcttctcccttattatcacgtatgaaagattattccaacattgtcgagcccacactagaagatccaactttgaaattaaaaagaatctcttcttttcaagaacagcccttaaacaaacttttgaaaagagaaacttcgcaaacggcgatgctcacagatcacgaagacaacatagtggccatgagccttacttcaatggcaaacagtgcggcgtcttctccgaggttgccactgtcaagattgaattcatctaatgaactctcaaatgcccaaccattgcttgacatgacaaacaatactcttgccttcccgcgacctaatggaccatctggattgaaccctttattatatatctctaacaagaatattagcgggatatctcactcggctccacattctccagtgaatccaaatatatcgctgataaaacgagttaagtctcccaacattgtaacattaaatatatccagggaatcgtcaagaagccctatagctctgaattacgaggcaagacaacaacattcgcaacaacattcattctccacaccatcaaccgtgtcaaatctctctacttctgtgctcgggccactgagtgacacaaacgacataaaaacaccgcaccctgaaagaccaaatcacaagacagcaaatagaatactcaaaaaggaatctcctgtcgagacatcaaaatcaaatcttatactttcaaaggttgcatccactcgccaagaggattcttttacaagccgaaatgacgatctggacaaagaacaaggctcttctccattaaactctaagtttgcgcccgaagaaatcgtgttatcaggtaagaacaagatttatatttgtaaggaatgccaaagaaagttctcttctggtcaccatcttacaagacacaaaaaatccgtccactctggtgagaaacctcattcttgtcccaaatgtggcaaaagatttaaaaggagagatcacgttctgcagcacttgaataagaaaataccgtgtatttcaaacgaaacaacagtagatgctccaataatgaaccctacagtgcaaccgcaggacgggaaagcggccattaatcaacagagtacacctttaaactgactcacgattgccagttgtttaccgagatctctcattttgaaggctcttaaaatgtgctcggtcggccgggaattcgcgaaaacccacattcactaataaataccattacaataaccatcattatatagatacacatgtgtagaaaaggataatatacgtatatatatttgtttgtaaatctttaaattttcaggaacagggttagcaagcatcaatgaaagcagacgcgaaacaaataacacatctactcaaacctcttcgacttttattattgggggctccagggtcaggtaaagggacacagacttcgagattactaaagcaaattccacaattatcttcaatttcgtcaggcgacattttacgtcaggaaataaaatctgaatctaccctaggccgagaggctactacctacattgctcaaggcaagttattaccggatgatctcataacgcgtctgataacttttcgtctttcggcattgggttggttaaaaccatctgccatgtggttgctcgatggatttcctcgaactactgcgcaagcttctgccttagacgagctgctgaaacagcatgacgccagcttgaatctagtggtagagctagatgtacccgaatccaccatattagaaaggatcgagaacagatatgttcacgttcctagtgggagagtgtataacttacaatataatcctcccaaagtgccaggattagacgatatcaccggagaaccattgaccaagaggcttgatgacacagcggaagtgtttaaaaaaaggctagaagagtacaagaaaacaaatgagcctttaaaagattattacaaaaaaagtgggatttttggtaccgtctctggggaaacatcagatattatcttccgaaattattgaaccttataaccagcaaattcggctaatagggtgatttaacgctacactaactgcaagtatatgttaaccttccccgagactttgaaaaaccgtgactctagttggaagtcagcatctcgtcaaccaaatgattacagttcactttgaatattctgaatagcctttatgatatgagttaatcctatattaatcatggccgacggcatttaagcgatgtatatgaaatttatgaaaaattaaagtagcgtactttatgctacatagcttttgaaaagaaatctctggtctgtaaataataaataaatatatatatatgtatatcttaaagttgacaaagtactgttagccattcatagaaatactatatttcatcttgggttgaaggtgataatcggcccgatttgactacactttaagaagattggaaacaatgaagttttatatagatgatttaccagtgctttttccataccccaagatatatccagagcagtataattatatgtgcgatattaaaaagactctggatgtaggtggaaatagtatcttggagatgccttcaggaacaggtaaaacggtctcattactatccctcacaattgcctaccagatgcactacccagaacatagaaagatcatatattgttctcgtactatgtctgaaattgaaaaagctttagtagagttagagaaccttatggattacagaactaaagaactaggctatcaagaggattttcgaggtcttggcttgacatcaagaaaaaatttgtgtttgcatcccgaagtgagtaaggaacgaaaaggtacagtagtcgatgaaaagtgccgtagaatgacaaatgggcaggcgaagagaaaattagaagaggatccagaggcaaatgtagaattgtgtgaataccatgagaatttgtacaatattgaagtagaggattatcttccaaaaggcgtattttcttttgaaaaacttttgaaatactgcgaagaaaaaacactttgtccatattttattgttcgtcgtatgatttctctttgtaacattattatttattcttaccattatctattagatcctaaaattgctgaaagagtttccaacgaggtttctaaagatagcattgtcatttttgatgaagcgcacaatattgataatgtgtgtatcgaatcgctgtcattagacttgacaacggatgcattgagaagagccacacgaggtgctaatgcgttagatgaacgtatttctgaggtcagaaaggttgactcacagaaattacaggatgaatacgaaaaactagttcaaggtctccattctgcagatattcttaccgaccaggaagagccatttgtggaaacacctgtattgccccaagatcttctaacagaagcaatcccgggaaatatacgaagagccgagcattttgtttcatttttgaaaagattgatagaatatctgaagaccagaatgaaagttcttcacgttatttcagaaacgccaaaatcatttctacagcatttaaaacagttaactttcatagaaaggaaacctcttcggttttgctcagaaaggctatcattacttgtaagaactttagaagttacagaggtagaagattttactgcattgaaagacatagcaacttttgctactcttatatcaacatatgaggaagggtttttactaattattgaaccgtatgaaatcgaaaatgctgcagttccgaatccgattatgagatttacttgcttagatgcatcgattgccatcaaaccagtctttgagagattttcttccgttattatcacttcagggaccatatcaccattagacatgtatccaagaatgttaaactttaaaactgttttacaaaaatcatatgccatgaccttagccaaaaaatcatttctaccaatgattattaccaagggttctgatcaagttgcaatttcttcaagatttgaaatcagaaacgatcctagtattgttcgtaattacggttctatgctagtagagtttgccaagatcacacctgatggaatggttgtttttttcccctcatatctatatatggaaagtattgtttcaatgtggcaaacaatgggtattcttgacgaagtttggaaacataaattaattttagttgagactcctgatgctcaagaaacttctttagccttagaaacctatagaaaggcttgctcaaatgggcgtggggcaattttgctttctgttgctagaggaaaggtatctgaaggtatcgattttgatcatcaatatggcagaactgtgctgatgataggtatcccgtttcaatacacagaatcgcgtattttgaaagctcgcctagaattcatgagggagaactatcgcatcagagaaaacgacttcttatctttcgatgcgatgagacatgcagctcaatgtctggggagagtactgagagggaaggacgactatggtgtaatggtactagcagaccgtaggttttcaagaaaaagaagccagttaccaaaatggattgctcaaggtttgtctgacgccgatttgaacctttcgactgacatggccatatccaataccaaacaattcttgagaacaatggcacaacccacagaccctaaagaccaagagggtgtatctgtttggagttatgaagatttaataaagcaccagaatagcagaaaagatcaaggtggatttattgaaaacgaaaacaaagaaggagaacaggatgaagatgaagatgaagatatagaaatgcagtgatgcaatgatacgcttttgctataaactgtatatatcacaattagattaaatagccgcaagagaatgttatatattgaaatccattcgattatccaggactaaacaatgattttatttcacatttatttcaaaggacaactctttatctgcgtcaagatatgaatcacagacacaccaaattgttaagttatgtttaccagatgtcggagtgtcaaattccaattcatattgctgagtctctttatttaaagtaactttcttgatcgcataaagctcttttttagatacttcacctaaaaccaaccaccaactttctagcttatcaaacggatacttttcagatgttacttgtaagttctcaggttcaacatctcttgtcaattgaatggtaattttctgttttacacctgaaattaacgaatcagaattattcaacgaataagtaagttcaacgttggggtaattgttaacaaacgcggcgacctgcgcaagctgtgaatcagtaagcgttaaaatttcatccctctcttcatcctcaagggccattatatcatagaccgtctcgacgttaatttctttacatttttccaaaattttgttgttgaagtgtggaatctgtctcaacggattatcaacgtcccatacaccctgaatcaacatctgcgccaaatccatggcggtagtagcattcaaatacccgtttgctgaaaggatatcaaccactacgttaattagtggaacaaccttttctagaatgtcttttaaatcattttgaaagtcgacaggtaattcaagacgtgaaaaatatgcttgtaacaataagaaaactttaaagctcaccgaaccagaagaggtgtgttcagggaatctcaatggtagtcttttacttaatttgacaagtaatgctctgtctccttttctgagtggaacactttcgaattctactgctgttgaaagaacatacagcatgtttttgagcgttgacgtattcgataaagaagaaacgaatgactgaatagtaaaaaatgatacgccatagtgagaagcaattagcccgttgctcaaggtagaaatgatttcagttgcttcatcatctcctccattaacttctgcggttacttcagcttctgtatcgtcaatttcaatgaaggatgattcaactaagtcattcaaacaagtttcaactaaattactcaaaaaaactgaaattccatgtggagacgtatcccttacgccataatagcttggattcacatggatacgacgatagaaatacgaatatgtaaaccagtcaacacaatcttgtttgctttgtataatagaatttgctatctcgttgttcagagtatcatgaataatatactgtaggtaactctcagtaggcaaaggctcaattaagaattttttgtagtaggccttcatgttgtgacttgtcaaaattaaaaccttgcctgccattgaatcgttaccactagctagtcccaccatttctagaagttcatttatggtatatggcatatatttatgctctgcaccatcataaaggttggttcctaaaataatcacttcatcagttttacaagcgaatgcagaacaatccttagaaatgagtaaaaccgataccgcaccatattcgtataaccttttcacaattctttcatcatttgatgccatccccttatacaaaataccaacaccgtgttttaaaggtgctcttagatgaccatctgttaacttttcaatgtatggtacaatttgctcttcttcaacgttcaacatatcccattcaattgcttttgaaaacttcataaatgcagacgcaacttccatacaatcctttctagatggtaagaacaccgaactggaattacgatttcccgctgcagcagcagatgcttcaaatgccatttgaagcatcgaaaaattgaatgatatgtgctcaacatctttaaatgactgaatattaatttcaagaggctcaattctttcgcttggagaaaagttgtagatgtttgacttcgtcataccagcccattcaccaaaatcacgagcatttgccaaacagttcgaaaggcaaacaaatcgaattttcttttcaagttgggttgctataaatatcattctagaaattagcgtttcatacacagcaccgtaaacaccttggctaatctcatgagcgtcatcatatatcattaattctaaactttggatgttcttcctttgtctccaacgacgtgacaaaagctcaaattgcacgggggtagccaagagaacatggctttttgctaataattttaaatttagtgaaggatcatttcctagcttatttattatcttaccaccagcaagatgagagaaccttttattccaatcagatagcaaaaaatcaattttttccccagacggattgatataaaccgctcttcctttattctgtctccaatgatttaacagtgctaattcagccatagctgttttacctgtgccctttcctgaacctacaaagaccgagtcattcgaattgtagagagactcgaagacctggctctgaatcttgttgaaagttttaaattcaaatacttcggaaaaatcatcattgccaagctctgatgttgaaatactaatattctccagaaggggagtaggaggaggaaattttttcggaagtttaaatccattgaaggaaactggaatctcgaattcactgtgccaccaattttctgatatcaaagtaaggaagaaattaggtggtaagttattttgattgtgctgctttaactcataagtaaaggataaggtaaattcatgaccaactatatctggagtgatgaatagtacgtcataataaagtattgaatcaccatcagtgtcttctagcatgagcaaaaaaggttcaagggaaccgtgtacattcatatcccatatccagtcggctattatttcaatgttgaacctcataacgctacgggtaattggctgagcgttgcatgttacggacattttgggaaatcttttcaataaatcgtaaacctgttttccatatttttcagatctgattgcacgaccaacttcggcaggtgtttctagctgtagataatctccccacggtactgtagaggcttccagccttttaatcacttcgacagggcatgttttaaactgtcttaaaggacagtttgttggccacattttagttgtggcagatttgcaaagatttaacaacatccgtgtgggatgtccccatcctctcttcaagcatatttcaaacatagcacgcaataacctaccagcattttggtgaataaacactatatcagaattaagtgcaaaaccttcgaactttagctgggaaaaataagactgcagtagtacattcacttttgctaaaggatcatcaatatcttctctgataggaatgggtgctttctctagaagttgttttagttctcttttctcttcatatctcaccgatacgtacttaaactcttccgacattgagaatattctaaaaagatcaatctgagttgtatgttcatctaactctctattgtaaacatccatggaagcatgatttatgtaaaatgacgacgctatatttcctagatcggtcgcctcaattacatcattttcagcatcatataacaccaactcttgttcttttaaaatgcatagggccgaatggactaagctttctctaaactttttcaattgcccatcacttgaaatatcaggtactttgtaaagcataggggaagctaacattctgacatataggtaagtatacgccaaccaattcacagcatcattcctgcacttaatgttacccgcgacaacttctgcatttaagttgtcaactaattttgaaacaaattgcgattctattggtaattgttgatttaaaaccgagagataatattgaacattcgattggtctgttattataataccctcgccaaatgtgtcatatctcggtctgcctgctctacctaacatttgaagtacatcttgtggagaaagttgttcccaggaccccttttcaggtgaatagacatctgttccttttataatcactgtatgagcaggtagattaacaccccatgctaacgtcgcagtgcataccaatacttgcaacaacccgtctgcaaataaatcttcagataaggatctgtcacttctggtcagccctgcgtgatgcgtccctataccgctttcaatcaactttcgtagacttggatcgagtacgttggctgcttctgtctttaaaatctgcttcgatcctgcatcatttttggttaatttatgagtaatgttctcttcagcaaatttatttttcaaccatgttgctgttcgtgatgtttcttttcgagaatgaacaaacacgattatttgattaccttcattgatggattccaataccttttcataacaagcatcattcatagccttcagctttttcaaggagttccgttccttaatgccacaaaactgttgagatagaggacacggtctaaatgaggagtcaaaataaaacaatccttccttcggaactcttaaaaacctaccgacatcctcataatttggtaaggtggcagaaaggcctattattctggggtattcctggccatatttggaagcccaaaatgtcctagccacgatgctttccaatactggtcccctgtcatcatgtaacaaatgtatttcatctataatcaacaaacgaacaagttctacgatggccaaattatttgaatttctagtagttatgtcccatttctctggcgtagacaccaaaacctgcgtctcgtcaatttgctttctactaagcctagaatcaccagtcaattcagcgacttttatacctagaaaagccaacctcctttgaaattctcggacttgttcctgtactaaggctttcaagggtgctatataaacaattttaaatgcagaaaggtttaatttcttagttttcgggttataatgatgggataaggctttcaataccgtcaataacgcgatattcgtcttacctgaaccagtgggtgcacatattagcatgtttgaatcaccttcaaatgctgcgtgaaaaacctttgattgtatagggtttaaggacgttgtttccgatgaaggaaacgcctcctgacaccaatctggtagagaagtaatttctttcaactcataatcaataacaggtttgctaggagctggaatatgtatttcgtcatattgtggtttcacccttttgaatgatccttccggtagggatacttttgtcacggtcattaatttagaactttcgtcgaatttaatcttttccaaatctatgacgggcggtattgctggattactgaattttgttctttttgcttccgaagactgtggctggtcgtcaccggaatcgagttcacgctttgagtgtgtagtttctctaaatttatactgttccacaagatcattcaaaccttttgcaaccattttctctattaagttcggtatttcattctctgtgctcttcgccagtcgtatgccccaaaaaattgtagatctattcttgagaataaattcagccagtgatatattctcgaatttaagcagatcaaccaacttctgctccaacgctactggattatgctcaagtgtttcaatatcattcaaaattttttctgacaggtcttgtattacagaggtatccttgtaaccaagctctgaccgaagttttctctgcaaaaaaaattcatcgattgagtatatcggaacgctctcgatattacttgttttactatcggagagtttaattatatcgttttcaatgtttggcaatgccctcttgtttttttttttagaattgacttcaacgtcattgtaatcatattcctcatcatcatcttcattatcattgatttctcccccaagaacattagcattgttggacatttctgttacttcttcttcatctgatttttcatcatcggcaagaattgctactgcttgtttattgctattgtcaggatgtgtttcataatcggtaatgtttttcataagtttaactaattcgttaaacttcagggagtctatattgatgcctagctcatgctggatcttttcctttcgctcttcaatattaccatcctcattttcctcattttctttcaattgtctgatgaatatatcagcagttccaataataagatcatggggtatatcattgcctaaaacttctgtaacccactgcaaaatctgctcgtaagtttcgacatttgagggatcctttggataataatgtaacctgaaatcggaggaagaattcaaaatggtgttatgctgctgaatttttttcaatgatgcgctctttccagttttttcaacggctacatcattttcttttagtcctttattaatgttattgcacaggccctgtcccatatccttagcactaattctaccactcatggattttggttgtgatatttccgcatccctttgaggattttggctggtattcataaagcgtttatcaactttcaacaccttattggacatctcatcataacgataaatttctctaatttttttggccttatccttcgtttcatgctcagtcatttttaataacgaaggctcacggtaaatcttccaaagcaattacttatatttaccttcaccttattttactcaagattatctctattagtgtattattcctttatagtagacatagctttagtagcataaatttttaatattctcgtaaagagcgacaatattcaatattagatcgtcaaagaagcaaacacgcattgatatctgagagatcatcacaatgcgttaatagtacttgattcaacaccactaattatcaagtttgttcctgtctgaatgatatggatagtacgaatttgaacaaacggcccttattacaatatagtctcagttcattgggctcgcaaataacaaaatggagctcatctagaccgacttcgccagttcgtaaggcgagaagcactgaaaatgactttctttccaagcaagatacgtctagtatcctcccaagtatcaacgacgacggcggtgaacagtggtacgaaaagttcaagcccaattgtttggagcaagtggccatacataaaagaaaacttaaagatgtacaagaagctttagatgccatgtttttacctaacgccaagcataggatcctactactgtctggccccagtggatgctctaaaagtacggtcataaaagaactctcaaaaatcttagttcctaaatacagacaaaacagcaacggaacgtcctttcgaagcaccccgaacgagcataaagtgaccgagtttagaggtgattgtatagtcaacgatcttcctcagatggaaagctttagtgagttcttaaaaggcgcacggtatcttgtgatgtccaacctgtcattaatacttatcgaggaccttcccaacgtcttccatatagataccagacgtcgatttcaacaacttatattacagtggctatatagttcggagcctctattacctccccttgttatatgtataactgaatgtgaaattccagagaacgataataattatcgcaaatttggtattgattatacatttagtgcagaaaccataatgaacaaagaaatattgatgcatccaaggttgaaaagaattaagtttaatccaattaacagcactttattaaaaaagcacttgaaatttatttgtgtacagaatatgaaaatgttgaaggagaaaaataaatggaataaaagacaggaagtcatagattatattgcgcaagagactggtgatattaggtcggccattacgacccttcaattttgggcgacatcaagtggaagtttgccgatttcaacccgagaatccaccatatcatactttcatgccattgggaaggtgatacatggttcccatagcacgaataacgataacgaaatgattaataacctcttcgaaaattcgaacaatttgttatcgaaagaggatttcaaattaggaatattagagaactataacacatttaataaaggcgaattcagcatttctgatgcatcatcaattgtggattgcctgagcgagtgtgataatatgaatggtctaccagaatccaatgagtatggtttacgagaagtgcgcaaaacctttcgtaacatcagtaaacaaggccataatcatggaacggtttattttccaagagaatggaaagtaagaaaattacaaaattcatttaaagttcaagctgaagattggttaaatgttagtctttataagtacaacgcggtacattctttcaggaatataactctagaatttggctactacgcacctctaattagaaagtgtcagagttataaaaaaaaatacattctctattatttgaagaatcttccgagtggctcctcggggcccaaacaaaccatggacaaatttagtgatataatgaaagttgagaacggaatcgacgttgtggatcggataggcgggcctatcgaagcactatctgtggaggatggactagcaccattgatggataatgatagcaataattgtgaccatttagaggatcaaaaaaaggaaagggacagaaggcttcgcatgttgattgaccaatatgaaagaaatgtgatgatggctaacgacgatcttgaagacgaagaaacttcttttaatgatgaccctattgtcgatagcgatagcgataacagcaataatattggcaatgaaacatttggtagaagcgacgaagacgagtctctatgtgaaattctgtcccagagacagccgcgtaaagcgccagttatcagtgagtccctttcagattcagatctggaaatactctaactttttactctttaaatttgacgagaaaaccccaggaaatattccacacaaatctatgcacattacattctagaataaattaataaataaaaatatatacatatatattaatatgtatatatgtatgaatatagttttcattacaaaataaggcttactgtagagcatgttggaaatattcaggatcttcttctatagattccttgataatatccaaacctccctggaactccccattgatatataactgaggaaaagtaggccaatcagaaaacttcttcaagctttgtctaacgttttcgtctcttaatatatcaaaaaatccgaaccttatttggtgttctctgaggataccaactaactgtctagaaaatccgcatttaggttctgatgggcttcctttcatgaatagcatcacaggtgcagcttgtactagcttcaccagcctagcatttatttcttcttcagtttcgtcctcttcatcatcggaagacccgctgctttcctcatcagacgtagatttaggacccttggcattgttcgctagtgaggcagaagcattcgaaagaatttctaagcttttcacaaactccttaggatctgcggctgatatttcttttacaatagtaccattttgaatgaagacgaagtatggtacggctgcaatctcaaaaaggtctgatatttctggatgttcgtctgcatctattgataaaaaccggacatcctcttgcctaactttttcactaacagcttctagcacctggctcatagttttgcaaggatcagcccattgagctttaaaatataagacaatgagtttattagcagcgtttgtagtggttagttgcgtaaattggtcctggctttttatttcaaccacagtcatatttattggaggaagagcacagaaatttagttatatgtaagtggaaaaatgaaatatgctcagtacccaaagacaacaatgttaccgggaaaacgaatcaacgttcctggcagtaacagattaaaaaatggttcaactggtacagtattaatatgctatttaagctaaatatcaaccagtcttcagatatggtaactttttctaggacatctgtgaatacgtcgcgaggcttcaccaattaaaacgcgcgctcttactaaaatttcacgaatataatgcttattggctgaaattttcagacccttttgccaagtttgtaaaaagtattccaaacaacttcaattttggtgttggtggaaagttccggcctcctccttagtgactctttaataaaccaatctgctacatcttctttatctttgttctttggatcctgcttccactgatggtaagcgctccaggttctgacataatctgcaaactccactagggtgacctgctttctgattagcaatggcttctttgtatgctggtggagttttactttgtctctcacatcttctgcacaaaaatatgaaacttgtatatcatggaaaagttctgggtctaagtgagagtctttcagcatattacgaaggcgagatctccccggttgttcccaatagggtcccagtccttgcttcccgtaaggaacttcaatcatcagatcatcaaattcagggtagtccgggaaaattgggtccgcataaccccaaatagcgatagtaccatcttttctcaaattggcataagcagatcgctgaaatttttcgaaatcgaaccaatgagcacattctactgcggtaatcatatcaattttctgtttgtctactgaatccgcgcctaggaatttaaaatcatcacttgaagaaatcttaaatgaaacgtttttgtatgtatcaggacttccttcctttattacttctgcagtcttaatcatggtagcggagagatcgcttccgataatttgttcgaatggttttaactcctgagccatttgtaaagtggcagtacctggtccacagccaacatctacgagtaatttcctttctccgtcgtggtattcatcaatcatcttgtaaaaatcggagggataagaaggtcttgaagatgaatatctttctgagttgaaatcagaagcagaaaaggtagacattattatcacttattttgttatcttgttaggagataattctcataacaactaataaagactgctacaacgaaaacatactaaattagttacattccttttcctttaaaaatgaaaataaggaagataaactttcggaaaaccagaaaaaaaaaggatattactgtgagtcatgaacatcaacacataaggtgtgattcatttatagtaaacaacggcagaattgcacctaatttttctgattagataggttgatggaacaccctttttattggtcatttaacaatgcatgagactacataaaacatttatctgttttagtcaaaacaaacgtggttgtagaaatattctgcaagaaaattcgcggatgatatttgagaataaaatactcataatgatattgaggcagggtatattttttaatattagcgtgagcaccaagatcagtttctaaacattagcaaattattctaggtggtataagacaggctaaaaatctataattgaaatgtcagcatcttaaaataaaacaggaattaatttctaaatacgcaattgatccaagtgttatgtcaatatgacttactgagaacatactctggcgggctttacttcccgatctcacatgttgccttcaagaagcacaaaaaatttgcagcccaaacactgtcagacacgggaatcgatctaacatcgtaaaatttcagctgcttcgataaattggtacccaaatattggagagacctttcaccacaccgacttgaaatagtaaactcaagcgcaatgatgaaaattgggttgcaatgtatatttgatatcacaaataccaaaattagccgcttttttggtacgcacttataatcgaagaaattgattcttttttagatttttaacaaatgaggttatatgagaatgaagcaggtcataacaagcggaaccaaagcttactcaaacaagttatcatttccaactaaatcctacttgaactgcacctcttaaaagaaagatagaaattctatacaagcgctctcactcaataagaattgtaaaatgaacatgacagtgatgtgtcacacctcgatcggcaacgtgaattggttaccgtctatttagtaatcagtacagagatattgaagatgccgctatttttttttttttatatttccgccgtattttattcctgtgtagtcgggtaatggatgctatttgtatgcgattttagagtcttaaaatgctcaagagtgatgtataatgtaagttcatcatttgaagaattcgaacaaagttgtgacaatataaggagttccgcagactaagaagtactacacgatggattttcagtgcagaacgtgtagccaggcttatgatgctgagcagatgatgaagcatctctcaagtacgaggcataaaactgtattcgacacttcaaatgatgaagatatttgctgtgaggaatgtcaagataaaaatatacaccaacttcaaatcatcaggtttgggggtgaagacatggttttactttgtaattcgtgttttcggaaagaatattcagaaacggagcgtccatcaactagctactcattacaaaacggctctatattgaaattttgggaaaagtacgtgaaagtcagggaatgttgttgtgatgagtgtggggaagagtctaacttgaatgcaaatagaaatggagaagtattatgtgacaagtgcttgcccaaatcgaatagagctaaagactttgtttctgaaaaaagtggaagattcctatacatctacttgggactgaatgaaacacagaatagcactagaaagcctagaaaaaagggcggcagaagagttggtagaggaaagaagggcaggaagggtgctaagattaagaaggagaaaaaggaaactttcgaggccaaaataagtagaatcgcttatgaagtcaagaaagaaaatagtaccattcaaagctctagtagttccaatctaagaaacttcaaaggtttcaaagcggtggaaagcgatccagtagttgcagcaaaagtaagcaaatcagagactagtagaagtaatcctggcccatcaaatcgaaacaaagggaaaggaaataaggcaaaccacaaaaagaatagtggaaatgggataggaaaagagaaagagaggaaaacaaacattagaaataatgtccgtaacagccaacctataccagaggacagaaaaaataccaatagccacgttacaacaaactctggagggaaaggcaagaacgaatcagtggataagcaccaattaccgcaaccaaaagctttgaatggaaacgggtcgggcagtactaatactactggtttgaaaaaagggaaaaaagaccatgctggccagaagactaagggcaatgataaaacgggtaataagaatccgcgagaggccaaactaaattcagctggcagaaagaatgcacttggcaaaaaatcaaataaccagccaaataagggaactagcaggtggacaattggatctgatactgaatcttctagagaacctagtattagcccaaacgagaacacaacttcaattactaaatcgcgaaaccgcaataagaaggctagcaagccgacgctgaatgaaaaatcaaaaacaacaacgatgccaaaaaagttggagacaaaaaatcaagagaaaaataatggaaaaactaaggacgggaaacttatttacgaagaaggtgaaccactcacaaggtataatacctttaagtcaaccttatcataccccgatttgaacacatacctaaatgattactcatttgccctttttttggaacagaaattagagaacgaatttgttcaaaacttcaacatactatggcctcgcaatgaaaaagatacagcttttataatcaacgttgagaagaataataattcagaacttgagaaattactacctgcaaatttgcttgcactcggtagaccggcatttaatgaaaggcaaccatttttcttttgtactcaggatgaacaaaaagtttggtatatttttatcaaagaactttctattcaaaggggtaaatacgtgttgttagtggagcttttttcgtggaataatttgagtttgccaacgaaaaatggttcatctcaatttaagctattgccaacttctgcgcagacaagtagaattctatttgccatgacgcgtattacaaacccaaaatttattgacctattactaggccaaaagcctattaaagagatttattttgataacaggctaaaattttccagtgacaagttgaaccgatctcagaagactgcagtggaacatgttctaaacaacagtatcacaattctacaaggcccacctggtacaggtaaaacatcaacaatagaggagataatcatccaagtaattgaaagatttcacgcattcccaatattgtgtgttgccgcgtcaaatattgctattgataacattgccgagaagattatggagaatagaccgcagataaagatcttaagaattttgtcaaagaagaaagaacaacagtatagtgatgaccacccattgggcgaaatttgtctccacaatattgtatacaaaaatctttccccagacatgcaagtcgtggcaaacaaaacccgcaggggcgaaatgatctccaaatcagaggacacgaagttttataaagagaaaaaccgtgtcaccaacaaggtcgtatctcaatcgcaaataattttcacgacaaacattgctgcaggtggtcgtgaattgaaggttataaaagaatgtcccgtggtaataatggatgaggctacacaatcatcagaggcttcaacactagtcccactttcgttaccaggtataagaaattttgtcttcgttggggacgaaaagcaattgtcaagtttcagcaacatccctcaactggaaacctcactattcgaaagagtcctatctaatggcacgtacaaaaacccactaatgctggatacgcagtacagaatgcacccaaaaattagcgaattccccattaagaaaatatacaatggtgaattgaaggacggtgtcacggacgaacaaaaggcatggcctggcgtgcagcatccgttgtttttttatcagtgcgatttggggcccgagagcagagtgagaagcacgcaaagagacatagtcgggtttacgtacgaaaacaaacacgaatgtgtagaaatcgtgaagattatccaaatactaatgttggacaagaaggttccgctggaagaaattggtgtcataacgccctattctgcacagcgtgatctgctgtctgacatcttgaccaaaaacgtagttatcaaccccaaacagatttctatgcaacaagaatacgatgaaattgagctatttaacgcggctggttctcaaggaaccgccggcagtctacaaaacaatgtgattaacatcatcaacggcctacacgtcgcgaccgtagactcctttcaaggccacgaaaaatctttcatcatattttcatgtgtcagaaataacaccgaaaacaaaatcggctttttacgtgacaaaagaaggttaaacgtggcattgacaagagccaagcacggactaattgtggtgggcaacaagaatgtcttaagaaaaggagaccccctatggaaagactacattacctacctcgaggaacaagaggtcatattcactgatctcacagcttactagccggctaggcggcggcaagaaaatccactgtttatgtattgattgcgcaatgcagagatagatagatatagatagataatggacgtagttatagaacagaaaatcggtagatcgaaaacacaggggaaaaaggggggggggggggggagacagcgcagccacgtgacgggcttcctctttggaaagtggagcgaagttttgcggaagctactttattccggcctggagtcaaaagaggaagctcggtggcaaatagcttcctctttgtggccggggcgcggggggacgaggcaaaaagcaaagaaaagcaaaaaaaataaaaaaaaaaacaaaaaaacaggggtatgagaaaaagacacgcttttccacgcgcagcaaaaaggaaaaaggaaaaggaaactctttattattggaccttaaacctgaaaacgagacgaaccgtaacataaaaccgtgtagtttctgcaaaaataacttagtttttcctacttttcaaaattgagagcgcaagcaagtgagaagaaaaagcaagttaaagataaactaaagataaaaatgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttggccaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaagtattctgataaatctaaagagaaattactaaaaaaaagaaaaaaaaaagaacgggggtgtaataatttgtagttcattattgcaattatatatctatatctatatatgtatataacattaacatgtgcatgtacacacgtaatcgcgcgtgtacatgtctatatgtgttacttgaactatactgttttgacgtgtatgtttatttatctctcttctgattcctccaccccttccttactcaaccgggtaaatgtcgcatcatgactcccgacaataatcccctctggtatagcgagaagcaactttagcttcttaacggcaagaacttttttatgtttgtcgcacctgtatcttcacaaaagttggatacagcaataagaaaggaaaccacatttgtgccaatgcttgctgcttcattcaaacgccaaccatcacaattggtccgcgggttaggagctgttcttcgcactcccaccaggataggtcatgttcgtaccatggcaactttaaaaacaactgataagaaggcccctgaggacatcgagggctcggacacagtgcaaattgagttgcctgaatcttccttcgagtcgtatatgctagagcctccagacttgtcttatgagacttcgaaagccaccttgttacagatgtataaagatatggtcatcatcagaagaatggagatggcttgtgacgccttgtacaaggccaagaaaatcagaggtttttgccatctatctgttggtcaggaggccattgctgtcggtatcgagaatgccatcacaaaattggattccatcatcacatcttacagatgtcacggtttcacttttatgagaggtgcctcagtgaaagccgttctggctgaattgatgggtagaagagccggtgtctcttatggtaagggtggttccatgcacctttacgctccaggcttctatggtggtaatggtatcgtgggtgcccaggttcctttaggtgcaggtttagcttttgctcaccaatacaagaacgaggacgcctgctctttcactttgtatggtgatggtgcctctaatcaaggtcaagtttttgaatctttcaacatggccaaattatggaatttgcccgtcgtgttttgctgtgagaacaacaagtacggtatgggtaccgccgcttcaagatcctccgcgatgactgaatatttcaagcgtggtcaatatattccaggtttaaaagttaacggtatggatattctagctgtctaccaagcatccaagtttgctaaggactggtgtctatccggcaaaggtcctctcgttctagaatatgaaacctataggtacggtggccattctatgtctgatcccggtactacctacagaactagagacgagattcagcatatgagatccaagaacgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaattaaatcgtaaggaaaaataaaataatagtgctgtgatcgcatgatattcttccctggaagcgccattttatagcaagaaatgtaagtcaagtatattttaactgtatatcaacaatatagctcttttttatgccttgttgtttttcttcgggttttccccacacattgtgtggagagatagttattaacagaccggaaaatagccgcccaaggataaacttttatataaagggaagggtagttgacccaaaaaatttggattctacttttccagatttactttcacccttttatatttgctgtagtctgttatgccaatcaggaaagcatttgaacaaatatgtctgttacaggaactgagatcgatagtgatacagcaaaaaatattcttagtgtagatgaattacagaactatggtattaatgcctcagatcttcaaaaattgaagtctggtgggatatacacagtcaatgtatgttataataacatttttaaaacctctgctgtagaggttctttccccctttcttttactaactaataatttggaaaggaacttttatagaccgttttgtcaacaacaagaagacatctatgtaaaattaaagggttaagtgaggtgaaagtggaaaaaattaaagaagctgctggaaaaatcatacaggtgggatttatccccgctactgtacaattagatataagacagcgtgtgtactccttatcaactggatctaagcaactagattcaatcctaggtggtggaataatgacaatgagtatcactgaagtatttggtgaatttaggtgtggtaagacacagatgtctcatactttgtgtgttaccacgcagcttccgagggaaatgggtggtggtgaagggaaagtagcatatattgatacagaaggcactttcaggcccgagaggattaagcaaattgcagaaggttatgaattggatcccgagtcatgtttggcaaacgtttcatatgctagagccttgaatagtgaacatcaaatggaacttgttgaacaattgggtgaagaacttagttctggagattatcgccttatcgtggtagattctataatggcaaacttcagagtagactactgcggtagaggtgaactaagcgaaagacagcaaaagctaaatcaacatcttttcaaattgaatagattggcagaggaatttaatgttgcagtatttctgacaaaccaagttcaatcagacccaggtgcttctgcattatttgcctcggcagatggtaggaaaccaattggagggcacgttctggcacatgcgtcagcaacaaggattttgttgagaaaagggcgtggtgacgaaagagttgccaagttacaagattccccagatatgcctgaaaaagaatgtgtctacgtaattggtgaaaaaggtattaccgattcaagtgactagtttttgtatacttttttaatgaagatgacattgctcctttattaaacttttcttttactttgtgttactaatattattaatatcttgttatgattctttgttttagcagctccaaaagaaaggaatattataatataattgttgtaattcggaaaaaaaatattaaattactatggtgcatatgcgtatataaaattgagcattacctaacgccatatattactatctaaagtcctcacagatgatgtgttttcaaaatcaaatgattggagctcctcatcatcatccccggtaaactgctcggtttcagatccattatccagatacctcaacgggctagtgtacgcaattgaagggtacctataaaataaagtacgttcctctttcaactgaaaaaacccccgataatcccttgacaagaaataatacataatataatctcgctttctgacaagacttttcagttcttggtactctaattcccgttcgaaaaccggatatgtgccagcaatttcgtcagttattatagcgtttataatagcctcgtagtcatcgggctcaattctattttcgtagttgaacagacggtaaaaagggctacagtcataattatgctcgcattcctcgagaataatatctgaatcagattgtaaatgtatgatatttcttggcgttacaacaatagaatcctcaggccctgatattttctctatagatggggaatccggtatatagtcaaggttgatatctgttaattcatttgaatttaggttagcgcgagcttcaatttcgttaggcttcttgaaatttgccttaactgggatttgctttgccaattttttgtcatctagcttttttctatgattgaaatttaggtcacgaagccttatatgttcaagatccttggattttgtagcagctttttcctttatcaagaaactgcttgacttcttttgcgaaaaagggtgggtttgattttcatcttgatgcaacctctcatcgacatccattttgtcactgtgtctgagaatctatacttcagggcctgctacaagaagtagaaactaaaatacaatgttacaaatgcgagaagggttttttttatgatcatgagtgaccgcaataaaatctttcgaagctttttcgaatattttaacattttttctctatagcttctttgtggcatcgcccatgggatcaaaccatactggtttctttgtaaaacaggcgcaaaatatagaaactcagaaaaagagaaaacgagtagtggaaaaatttatcagccatttatgcgacgcatccgtttgactgatctacctatttaaaacagaaacctacgttgaaaagttatttttccaacacattactggatctcatcaaattgccaatgtaatcttctagataatcattttcttgctttagttgctcacacacctcttgctgctctaaggttttattccacaacaagtctaatgtatccttcagaagtttggtttggcgcatcatcctctcattttttgttccagcttctctttcgccaagattaacttcagaggatggctgcttgcccgtcggcgagccagtactaatgttctccgctgacattgtcctatttgtttgtttgctattataatttatctagtcaacaacttcgcagatctacaaactggtccttaagatgttttattgaagacatcattttttatttttttaagcagaacgtgctgtgctctcccttttgggcctttttacgattttcaaaaaaattggtctctagcgggatcgaaccgctgatccccgcgttattagcacggtgccttaaccaactgggccaagagacctgtaatctgtgttaaacctgcataaattatgaaatcatagcaacgtttcaaatacttcagatgcccccatcccttcgtgtagatgatgaaatgaaactctagaatatcatccatttagtagcattcttgctgctggtatagtatcatatgagatctaggaagatgaaatgaagcttgagaaagagttagcaagtttaatggaagctgaaatgcaagaattgataatgtaatgggaaaatgaagcatataaaacgataggaaaaataatcgtaatattattgtatgcaaataccgattaaatttgaggatccctatacccttgaggagaagttctagtatgttctgtatacatagtattgaagcctctatcaacaatggaatcccgataattatcacaaaattcacacaaacctcagataaacgtaacagtattagcatacataattatacccaggcttctcccacagtgcgcatgattcgctacgaaatcatcaatttcacataatattgagattgcatttgtttttgtttcttgcgttgtcacttttaattctgctgtattatcaactcctgcacttagcttctgcaagataaaatgacgacttgagcatcattctcagattcagttgaaagttgctgacgattttcaggggtcccatttctagtaaaacgacattagacatatactagaagttctcctcaaaagatacaggaatcaataaaagagaatcggcaattctaaatagcatattattattacttcttttgctttgtaagttgtaatttacaatcctattacattatcgtttcttgatttcaacttccattagatttgattatgactgccatcattttgggtcaccgtacgtgaacattggtttgcaacaggaataaaagtcttgagatgttgtactctgagcaaataaacaaaaggaattctttctaatatttcacaaaactgatttccaaaaatgtctctaagtactccattagcgacacattttacatttcatttatttaacataataccttatttaaagattgattaattttcgatgaggcataccccttggcagaaaaggaacaaactcacaaagtgcacaaagagtttataaagaaactaagaaaagtaaggaagagaaagagaccgtaccagcaaggccaagatgtttaaaagaatcgcaatagcccagataagaacgtatacaaatggcgttgttttcaagacagcctctaaacccaaaagaagatggattccatggacaatttttgggggaagttttcttggagggtggtacttgacacagcatatgacgttcacggacttactagcttattggagatatgatgccctacccaagaacgcagatgaagtcgtcaaatatcacgctgatctgaatagacgtttaaatggcctacccatagtaaaacagttggagaatgctggttttgtacaagtgattgctaatgaagaggagaacttgttagtgtcaagggcattaaatacaccaggtggcgtcgctataccaccaagagtttactacaaccccagtaggcgtgaaactgtcgggctataccatttaggaatgaaacttactggttatcctttcttaattcacggaggcattttagcaacagttattgaagatttaatgaaggaggccattagactcgaaaaaggaacaaaaaatataaaccaagaaaccaagaatttgagtatctcgtacaagttccccacgttagctaatcaatttgttgtagtaagaaccaccgatcttcagcaatacggtaacaaaactaaattaaaggctgaacttatggaccaaagtggcaacaggacattggtcaaagctaatgccacgttttctagcgaacaagggaatccaaaagaagaaaaatagatttgccgtctacttatttatttatttatttatttatacaatagctgtaccatgtaaataatacatatatgaaattattgaaaccaatgtatggatccatctccgcatactatacaatccatggaataatcatgtttttctaaaggaattggagaggccacctgttccataagacatagtccaactaggaggggcttttggccttcatgcagtatcttataccgttggaaaaaatcgtcataatacccagcaccgtgacccatccttgcaccagttttaatatcaaacgccactccaggcaccaatacgacatctagaatatctgattcctcaatatgcggttcaggctcttttagttgatatggaccttgaggcttcaaatcacgaaccattttcaaactactcattcgatggaatattaaatgtggatgatgatcttcccgtaatttgaagtgtttcgattcagaagtatgagtacatcttggcagaaagacctcctggccatcttgaaataaattcttaatgatttctccagtcgttacttctcctttatccatgctcatataacacgctacacgcctagaattggcggaagcgatcaatgagcgtactgcttgagaaatagtatgcgactctgcagcgataatatcgtagtcaagagcatttattacccttttgatttgacgtctcagtaattgcttagtggccattaattttttgtagctatataaagatagcgtagctgacagtaatttttatttttgccatttcaatgattaaatattattcggaagaaatctgagaaaattatatatatccttcaagagaatgaagctgctaactgattaataaaaacagctttaatcacaaatctctcacgacatgaaataaaacacccttgcaaacagatgtggaagactgattgccacaaagcttcgggctcgcaagcagaatggttttcaggaagtgacttactaagctcgaatattgtcctagatagcaaacaggcctttgatggaatcagtttgtctcctgaaggtttttttgaaataaaatgataaatgagaatagcagaccagttctacgggtaggattgagatataaaacgagaaaggcactctctcactgaaaagtaatgaaaaattatcagaactccaatctgctgtctttacatcctcgagaatatcgctaagctatcgatactacgaatgatccagatacgacagtcttcgctggcgatctttttggactaaatttgctcactgatacactaaaaagcctacgcaactacacaaaggtaagaaaccacaatcgctacccattaatccttattggcattgtagccccatataatagaagtgaaagagtaacattgcgccatttttcgctactaaataacctcaagaaatgtgtccagcttatggttcccatagagcgagaatatatgacttaaagcatatccctgagtgggttgcactggtacacactctgtgatggtggagcacattaattaaaactcaaaaaaattatcacgatatggacaaaaatctaaatgggcaagtatctctcacaaaaagacctcacgtattttatgaaattacaaattgacgtatttcaaccttgtttactctaaagttcccccatatagcataggggtgctttgggtttatttaatcgtcaaatatagtccgatttgtctcattattcttgtgtcggaaaaaaatttattgaagcgactactacctagatattctgcaatttttcctataatataatatgcctcaccccaatcagtccctctttatgacaagaaataagactacagtgttacatcagatactccacattccccctatcgaaacccaacaagagcgctatctcttatacaacatttcacaaaaaacatgtgatatgctttcaattgatcctatcaatatcaaaattatcattctcactgcattatccttcattttcgttagtgcgcatcctccattttgggacgtgtctaccaaataaagaatgatgcgagatacaaagtaggtgataacatcagaacccggtgttagaatgcaaggtataatcagcaaaaaaaaaaaaaatgtgtaaaaaaaaaaggtcggttaccagctttactaaatgttttctattgaataaaatcatagaattccataagtgactgtgacattttccacccagttgatacagttcaatgaattctcactgcagctatattttggatgcttctccactttgtaatatacattgtgatgtttctttgatgaaagatataaaatattaaaaaaagttgattcttacatctcatctttgtcataaaaatcctctggaatggcaccttagaatttctaggcacaggaaactattcgatttttctaatatatgaatctaagtcaaattcaatatctatgttatttcagaaagtggagtaggtgtgcttttaagagaacggatttatgacggaaaactaggttaaatagacgaagaaaagctgaagtaattatcgttttgctgaaactttcaggataatccctatcataatatattcctatcaagcgatgagcaacggaaagctgtgaattgtgaatgtaacaacaagactatgtgaagcaatttttaagagttatttcatttagcaatcttttgagacccgaaatactcaaagaacgataaaatcgtgggacgaataattagactagcaacaataaaaggagtaaatacaactagatttgtgagtgtgtgtaattgcgtgtagcttgaaagacttaccacagtggtatcaacaccatactcgaatcgttctagatcttgcataaaaaaaggacatttacttttacttactagttatgagccacctttgatttcatggtacagcccataaccttcctgaaagcggtgcataacgtaagggactagattagaatcacaaaaccttttattgcattctacagtattcgtctaaatcaagggattttatttcctaattgaaagtgatcaattgtttaggtgcatacttggtttttactctccgaggttttctttagtaataccaaattcagtgtcctcccaaaatagattgagaaggtctggtagagattctgcagtcacaaaattttcgaggctacaaaagtccatgccaactgaaacactggtgctgctgggtgacaacttctcataacaagcaccttcttgattttttccctgtacgccaataactctattattcaccaaatcacccatttccctatcaagaatgctgagaatttctttacggaagcttgattctttgtgttcgcctataatattcctgtaccagatacattcaatgtccaacgcagcttgaccagcatctgagcaagcctggccatattttttcaattcacaaaacagcgattccttagccattttctgtgaacgtgtgtacatctgacagcagatgcgtgttaggatgaaagaaaccgctgttccattttccaactttttagagaaggcgttgttgcccttgaaattaacattgccagagctcacaaataagtcattatatgaggctatcatgcggcacatcaaggataaataacatatcgagttccttctaggggtctcgataaaattcaaggtaatattcatcaagatggcatatatgaaccacgaacaacggaaaatatagaacgtatcttcgtgcttgagaacatccgtcaaaatatctacagatgcttcaaaggtttgaagcctgatgtcctttacgcaggaatcaagttcaattctctctctttcttgtagaagattttgtatccttaaaattaaactctccattccctgaaaacaacaaacctttgcaaatccgaaatgggtgtatagttcaaatacattactattttcagaatattgtttgaggaaagggattagtttgtcttgtatgcactgaaaaattttacatatttttgaaaactctaccataagctgtcgtgcggttccatttaggtctttagcgttaggagttgcaaataatctgtagtctgtaaagtgtcgattataaagcaaaccagagaataccgctgtaataattttcgttaatagaatatagccgaaagagatacaaatatcaaacttacttgggtcgagctccaccaagtttattaaagtaaaacagtccatcgaatcatctacccctaatccaaccacatccttgggaaagagacacgaagtcatttcatgtggtatcaatggctgcttaccggtgaccaatgaataccatctatcccaccagtagcagtcccaccataacttacgatattcttcggcagtgtcctcatcctgaccaatataatattcccaacgattcaaaccagcatccaaacttcgcctggacatcgtggaaataattcttcccagcacaaaaggatcgtctatccaatatctgtgtttcatcaacgagactaagccctttaaaatagtcaagtcgtacattgtcgaaaatagggatctttcaaaatattcaagacagagacaaaaaatcaactcatcttgctcaagaaaatatttcaaaggaagtaattttttggaacttttacgatccaacgccttgtggtgctgttccatcaattgtactccgtacataaaccagtctgttggtttattgaatttgattgtttggttaatgtttgtatttcctttgatttcattcgatatatttgacataatgtgttgaataagtacgtcgttcccacatgaaagtccgtttagctttgaataatactctaaaggagatatcgaagttactttaggaccagcatggctagcagagctagcgtcaagaaacttcaaaaataaatagatagtttctctcgtctccctatcattcgaacatgaaatcaattttttagttatccagctaatacccgtagaggcaaaatatagcaacggtgaatagaccccaaagtacatactgacattttgtgcagtattgctttcaaaagcgttggagaacctattcaaagattttgactgtttcccgataatttctgtttctatcgatttcaggccaccatacgagctaatttccttactgtccagattgaggtaaagctgaggttgtattttttcaagctcagtgcaaatgtttgctaggcctttctgtaaagaggccggtgcgcttggaggtaactgtgccttcaattttgctatgctgcacttagcattatccaaatcattactgagactaccagtataattgaaaaaagcctcaatcggttcacgaaattgatttctatacgtacattttgattgagacccaatacacccaaaacatggcttcttactgttgcacttaatctttttcctatggcatctatcacaggccttggttaccctagatttttgtttggctaatcctctttttgctgccatctcaataaaatataaaaagctaaaaagcttaaaatttaaacaacaataatgtcgttaacctaatgcgcttattcgatgagatttggatttgcttctagcttatagaaaggaagaaagtttttactgttcaaagcacacatcaaaaaaattattacccagcctttcaaacaaacaaagtactccaaaatagttatttttgaatactagcaaaccaaccaatcactttttttgttggattatcaaataagcctaatcaggtctttcatgcagcgttgaatccaggttacttcaccgcaccttaagttaagatcaggacagtatcggctgttcctgagaaaccagccatattcaagtttcggtatcctaaccgttgatattgtccttatttgtcgaccttcaaatattgtggctgccatgtatatgagcgcctcgatctattatgactaagccatgcgattgtcgtgtaatggtatcgcgcatactgaaggtttcagccctgttttgatgtgccgcggcaaagtggtttttctccatacaggatgaagtgtttctttccccatgccgcggcaagctcatcctaaataaatctcaacttttcaactaaatgtacttcaattgaacaaatgccaagacctcaaatgaatcagtataaaagcacctaccgaatcaattgtgggatgtatagtctcttgcctcaaaatgtccaggatagtaggttaatagtgtccaattacatagctacttaatcttttattgtccatcaacgttccaaaatgtccacaactgattcggggttcgtactttaccactatacgccaagtaaagcggctgcaatcgtatttgtcgtactcttcattataatgacagtcatttttgccgttcaaactttatatgctgcgagaaaatcttctaaggcattgaaaaataatccatttgagtcatctgatgataaggtcgatagtcttgaggatgctgaatacaagcaactaaaaatcacacccacagtttttgcgtttatacctttcttcactggctgcatcatggaagctgtcgggtatatcgggagggctctatccagttccaatcctgaaagaacgaccccatatattatccaatctgttcttttattagtcgctccagcactaatagctgcgacgatttatatgatttttggaaggttattacatgttatgaggtgccaatctttaattttgatttctgcacgctttggtacgactttctttgttgtgggagatgtgtttagtttctttttacaagctgcaggtggcggactaatgtctaaggcaggatcaacgaagactggttcaggactcataactgcgggtctttttgtacaggtaattttttttggatttttcattatcaatgagataagattcacagtaaatgttaaaaggagatgcttattttacgaagatatttccagaaagtggatctttgtgaatgctaccctattattaagcagtatgttgatcctactacgttcaattgtccgaatagttgaatttattcagggattcaatggctatataatctctcatgagtatttcatatatgtcttcgatgctgtacctatgttattggtaataatagcatttagtgtgggatcctttttcggcaacgtattcgatgttataaaggagtgtcaaacgttaagtaattagataatatatatcaaattttgatttctatgtagtgcagccaatcaattttaacttcatttagaataaaaatctttcctcttctgctttgaagccattaaaacgaaagatctaggcggtactatttctccattctcagccgtacaatcatgcaccgaaaaggaaggcaatgtattgaatttttcgccgagaacaaaatatttgtaaacactcgttagattccgcattgttaagtggcatcacaaacacaatcaagattaagagaaaagtagctcgttgagaaagattcttgtacatatcgggatacttctgaagtctaataaaacattcaaataaagacagactggataaaagattcctgaacgtcaaaacttatatcttcttgtcccttggaatgtctctctgctcttatattgttgctgttgagtggtctcatgacaataaagtatgtcactgaattgaagactactgaaccatggcagctaatacaatcacgcccatccagaaaagtgtcgtgtggcgaaaatttttgttcacgttgaacagagggtactgatttcaaagtgctcttaagtcgtaatgacggccctaataatgatttccagaccctttggaaggagtttcttctttaagtactgccctccctgatctatatttgtaggaaatttttaaagtacctagcctttttctcagtcacggctgtagagtgtacacagagcctttgaagtttggtgctttacgaaattaaagcagtcacctatgtcatttagctacaaaaaactcgtctagaagaacagcacatcggcctcctatatcggtactcatcacagaatcaatgtatagtatgtgtcaaggagaatgtattaacgccaaattaaaggcacactaacatgtaatgaagctggtgttatatattttttttcaattgacgtgaaactcagtgtcttagaattattttttagttcaaagagtacggctattgaagtgagccacaatgtcatttagctttataaacacaagagtaaaagtgcgcttgtcttcgcctcaatgaattaatggagcagaaaatttcttaacggtcagcaatacttgaaaataattttagcagttcaaactttcgttgttatcttgatactgaactctccttagtattcatataaatgattctatttaatagtcccctccgcagggtaattttaaggccttcttttatttccaaaggaattagtatatagcatataatataatttatcaccaaatcaacagaaaatatcataatagcattaacccgcaagaatttctttaaatgaacacagttttctgcagtgttaaatagaaatttctaattatcctgcatccaagacatgaaatcggtatattcaaggaaatttattagcactgaaatgcatatattcatttttgttagccacggaactgaactctcattataatgtggcggtccggtttcccctaaaaataattgagggcatatatgcatatcttttcgagactcaggttgaaaaagagcctccttagttctgcacatacatccaatagtagggcaggagtcccaatcaaatttaggtatgtcctctatgctatcacccacctctggtaaacagccaattgcggcctttatgatgaacagtgaggaattcaaattaaatttactctctgaggtgaaaacccatttcataataacctttttatcctctacaacatatactgatctaatttcagagcatctaaccagtgtcaatatcctaaaatcttccttttttccgaagttgagctctagtatgtgggatattctctccttattgcgataatagcttgttttcttcaccttaacagtgcaaaaaagaactttaaacagagtgaaaccgtcgcactctccttttacctcataatccgactcttcagggaagtccccatttttcaatatctcgtattgataaaaaagaaaacccacataatctcgcctaacaaaaaaaggcttcttagtgcggaaggcaaataacggcaagccctctccatccgccgtaaatgacttgaagggatgcttcctacttgcaaacagatttatagatcgttgtgatttgaatattagatcgtctttgaaaacacgaagcttgaccattccagttttcgttacagtatcaaatttaaacttatccggaacatccttcctgtcttcgttagcgtagatttcttcttctatagcctttactcgaggctcgtaaccatcaggatgccacagcatgatactgtttacagaactcgatcatatactagaacctttgacttcggtaatcagcccgcatcctatgctttcatttccttggcgtatgttactgactagtttcctggcttaaaataggagaattcatcctcttagttattttcttggtggaccacgtgccttgcttaaagcagggcgctgccgttgttgcaacagcattttcagactttcctttaggtaaaaaaggtcaaccaataattttattttatttctgatgatggttgcgcgttccaagaaaatcaaaaccttgggcctcatcctcttctaagacgtataatgcaatcaagaaacccttcccaaaacctaataaaggcttgttattagtttcaaattcaggcagaactcgacttggatcttttaaacttttaaagtcgtagaaaataggtgcataattagctaaaacagaagagactcaccatttgaattatataactttattaattcgagtaaaacatccatcaggtatagcgtgttgcggaaagactttttttactcttattgtaacaaatatgtgttacaatttacctgtaaccttgttctgtataaaattttctctcgttgtcatatgccaatctttatataattaatagaaatttaggaggaacacaagaagaggggtagatcccgacaagccttaacatacagacgtaaaattactcgcaaatttgcgaaccacttggtcaggtgcggtacgtaaaacgaagatttgtacaataaaaatattgttggtttagctagattatattctccgatgattttttaacttcgatttccatcaaattttatattagacagtaatggagtttcaatttcgaagtcacttcacttgaagctgaattatactaaaaaaattttcttttacttgatttattgctctgcagtgtctgatagtgtaatggcggataatgcaaagaagagtaaagggaagatattttatttctttgattatacaaaatttttaacttgtatgtgatccctgtctttaatatcgtttcattatacaaactaactacagaaatagctaaatgagtgattactgtgccatcattttgacttcaaagatcatctatatcttgatataacatctacctgtcgaaagtaagatcatccctttgcgggcatgtaaggtgtaagatataagaacaaacaattgctagaaaatagctttgaatgaatgttaaaagggactgaacttagaagtgtgcgattttctgttttcaaaatttgcccaaagcgcttcttttctttttaagaattgtatagatgtaattatttaacggatgtctgacattattgaaccttcctaactccacaaaaataaccaacgggacctctaccttactaaaccacttcccgccccattaactaaccagcataacctagacaatacaaggaaatgtacttcgaaattttaaggtaaacgcaattcttgtcacaatataaagctctcactgtgctcatacactgcttcgataataaaaaccaaatggtttctactaaaacatagcaagcctcacaagatatagagatcacacaccattgaaaaagaaagttcagcaagtttgctggaggttgcaaagagactaacgaagggctttcataacgacattttacagttattgataaaagaatgcttttacgacagcagaacctattggtttgaagaagatagaggtctagtagtatattgttgctttaatgattcaaactcttaacaatgtgggcaaatatgcgtatgatttcgttctgggaaaggatagtaagaagcctttttgattacaaaaccgtgaaagacggtttagcagcttttacaggaaacctgctttaccttagccagtgttttctcatcttcaaaaaaaagtattgtacgcaactcttccatctagcagagctcccgctctttttcaaacaagtttcattatatttattcttaataattttggtatcatcgaggtgaggtcttcgttgtttcaacaccagctatttttcagcggcttacaattacgtagttctattaacgaatacactgggaggtgagtataatcatggactgtaacactatacgactccaacacgttatatgtatcagttatatatatatattatattattttgggaagagtagcattgcttttgaaagtacacggggtttactttggctcatagaatgggtctggatatgaaattctgaaatattcagattttggagtactgaaaatatttagcaagaatttcaaatattagttagtaaaccaaaccaaggcatctgaacttgaacctccataactcgctttctaacataatgagcttgtatgacataatattatagaactcgaggttaacctttaaatataaatatagtaatcttcatgataataatttcagggtagtgcgcgtatttgtcgaaaaaacgcaaaatgacagaaattctatgtttactgactttagattttgttttagatcaattggcggaaaaaggacgcagtctgtaactttgattggcatcttgatttgatttgttgggtggttctcttacaatcaatggtttatttcatggaaagcttgatgacatgtgatagcacaccatgctaattagtgaaaagagtccttgttgacttaccacatgtgcagccgccttttaccgtggtgcgaagcatattgagcggcctggagaccaagaatgtcagggcctttaaacaatagaagaagtgtataggaaaaaactaaggtgttttgagatattttttataaaagtagtatttcttaaaaatcagcggggagccattctttgaaggcgcgcttgcaaattttaggtattgggcttgattattttggcaagtgtcatgcattgtaacaaatctatataaagtgacaattctggaacactgtatcgtaatcccaaataatgtatgtagaatagaaaaaaatatatgaaaaaatgaatagatcatacacagacgacatgaatagcagccctccaaattacttgacaacaaggacgtttagaatcgttagattgtttgcaataatttttgcactgcttttggtagcgtactcattatttttaagcacacttagaactggagctatacctgaccgcgccaacactgctgctctagtacggcgagctaggtgatcatttgcgactggattaggactaggaggatttttaattgctgcagccgcttatgctactccttactgggtcgcagcaacctgtatcgcatccactagcggaatatgttcacctatagctggtgctgttttagcaacttcagcagttatagttgcagcagttttagtgggaaagagttctggctcagcaacaaagcgagggttaagtgagactattaatgtactgaatcatactataacactcactgatcatgtgctcaatgggcaaacattgtctaatggtactggtagtaattttgttacaatagagtttagtgggtatgcagtacatgacactattaaacgtgacggtgctgctgagatcaactttgtggggtatactacggagcatggaacccacatcagcacgagtagcgtacataatgtgagcatgctcatcgatcaaatcgtggcagcggtaccaggggtacctgatataagtggcaacgcttcggccctatcgttacagagacgcagtcaagagttcgccacctcatggatatcaatgacatatagtcagagttatggtgacctggcacagaactggcagaatgacgaaggtggagcaggaaattttgattcttatgctgaagagaagttacagaatttcttttcaggtaatagggattggaaatactgctttgctgctgaggacacgaaaaacggtgagccacttgattacgatgacatacctggtgacggtgcaggcacgggttcggcattcaagtctgagatatattttaacacttacggtggtatagataattattgtaatgacgagcatatcggtgctcagaacactggagatggtcgataaagctttacgcctgtcgctgaattgactgacccgaaattaagaactgttgacgtagtgaattacgatctagtttatatgtcataatgtagtaagtttattggacccttctatatgttatgtaaatgtaataattacatagttactgcttttgtacatagaaactatagtttcttaagtactaccggattagaggtttgctactatatgttttccttgtctcaagcattactgaaacaactctgaaacaatactaaaacattactcatatcatgcttttgggttaccacattcaacaataactcgaatacatttataaaaaaaacaaaactaaggtacaaaacacacaccacaccacatacgcgctgattggttttatggaagctaatagttcagacatagctcagaaaaataataataagtattatcaaatataactcatctggttacatgctaagttcttgtcaagtgatatagcgttatctttattattgaattaaattctataattagaattcgactacaccaactaatgactctaaaaaatatgtgattgcccttcaagattgcattatttctcaatgcattacatacatagagtatactagatacagatagatgattgtaagtgttggaacaagattcaattatcatcctatttattgcgatagacgcactacttgagagtgatatacttacttatgctactgcattcaaagagtaccactaaacaatctcaacagaatcaatcagacttttttttgccacaaaaacttttaacgatgtcctttggcagtactgtattttgagattaaaggcgttcagtcaataaaaaatctaaattcttgttcattttcagttctggtatttttttcatattaatgatggggtggctctggaggctcatttttcccactgaagatcgctggtaatttcgttcgtatgttttaaagagaactatatcctgtcgccaattatgtgcagttgatgagaaaactaagatagaaataagtagggatggaaccaggatccacaagaagcgcgtttagccgatccggcttatcaggtacgagaagcagtattattaagtaagaaagcgcgcaggaaagcggccttttgaaagcacgtctgcagacatctcacgacacattcccaaatagggccctgctaaaaaaaaagcagcagagcgtacgttgcctgggaagcatggtttagcgtgttgctatattatggtaaggggggtggtcagtatacgttgtgctgactgccagagaatatccttattcacaattatttgttgagtttgatacttatttacagagactatatataatgacacttttggaatacagtatcgctactcaatatcataaaaaaagtaacaataatgatgcctacctacctaggaaagttaacgtggtcatacttttttaccactttaggactagcttgtgcttacaacgtaacagaacaaatggaatttgatcagttcaaatcagattaccttgcctgtctcgcaccagaacacagaaacattgtagtcgatttggctagtaatggattcataacaatttcaccgatggcgaatgcaacaattgactttgaggatgtaactagtgattattttaactgcactgacgtcaatactaacgtacaggttacgatcgcgtcattttacaatgaatacggttttgggcccgatgataacggctattatcacgctatggaagaaccctcagaatttgaacggcatgacatggatgttaggctctacagaccatactatccaggtgagtttgtcatgggaagacgttcagatgcacttggagtgactggttttgaccaaaaggactgcgcaggtgagggtttttacgacgaacaaactgcagcaacgtcatgtcaaaatataggctccactcagtacgccaagtcggtcaggtcttataactatggatgctgcggcggggcggtctggatcaggatttggccgcatcacaattgttcaaaaggtcatgatcaccatttcaagataaggccaggccagatgctatgctggaatgtcaacccatattcttggatgcaaccagaatccggatggaatccgtaacgaataggattctggacatacgttaggttcttgtcgaatgtgataacccaaaagcatggtacaagtgatgcttcttttttgtgtcggtaatacacaaggagaacatatagtgataaacctctaacccactattacttaagaaaccctagtttctatgcacaaaagtagaaccctatatatcttatatttgtattacatatataaatgtccagtaaacttaccacattatgacatataagctagatcgtaattcactacgtcaaaattacattatgggagtgaaagtataatggagcacccgtgtgagtatgtgcttgttgacgttaacgaggatgaacaaacgacaaatagattcgacgtattgaagtacttcttggccacttttcatcttctgacgcggtgagcttttaagagcccttctttttcgactggccacgtgagaagacatacagttcagcttacatagctttggcccatacaatacctatgtgccccaaaccgcagagacgattagcacacctttttacctgcaccacagtcatttctcgataatggtgaaaacacagtgataccaccgcacagcaaaggtgctgccaatggacttgaaatattttatggagtgcgaataaaaaaatgctcatggactcgaatatgagatgcaaagccaccctgtgcaaaatggttatccttgtgggagagtgttacgacagtgatgtggcatattattctaatgtatggtctgtgtaagtacgaaatattctgaaatggcatccgttcaagcaatggtaatattaaggaacttatacgttaatgacgtcatggtggtattgatacgtaattgagtgtgtttatgtattatcgttgaaggatagaatatttttatgtttaggtgattttagtggtgatttttttgtaatattgacataagtgtatataaattgagtggatagtagatggtgaaaaagtggtataacgtatgtattaagggcagttatacaatatttggggccgccgaatgagatatagatattaaaatgtggataatcgtgggctttatgggtaaatggcacagggtataaaccgctgaggcaagtgccgtgcataatgatgtgagtgcatttgtactgatttagtgagagatgggccatggagtggaatgtgagagtagggtaagtttgagagtggtatactgtagtagcatccgtgtgcgtatgccatatcagtatacaagtgagggtgagtatggcatgtggtggtgggattggagtggtagggtaagcacgtgtgtattatttacgatcatttgttaacgtttcaatatggtggtagaacaacagtatagtgagtaggacatggtggatggtagggtaatggtagggtaagtggtggtggagttggatatgggtaattggagggtaacggttatggtggacggtgggttggtggtaggaagtagagggatggatggtggttggggtggtatggttgaatgggacagggtaacgagtggacagtagggtaatggagggtaagtttggagacaggttggcgagggttagattaggatagcatatctatgtcaccttattgcatgctggatggtgttagacaaggccgtagggacatatagcatctaggaagtaaccttgtacgaaaataggcaatatttcctgtttgacgcagattttagcccaaagatctagcgttaaggaatttttttatagtgggacattgcaaaccaaggaagtaacttgatacgtcgttggtgaatgggtctgttttcttattcggcggggtaatacattttgagggaaggttgtctgtctgacgcgccatatgtaggtacgccaaaaagggctcctttacttcgaagcgcgaggtcgtatacctaataaggaaatgtaatttataactttttattatattggtcttttcgagagcggaagaagttgtaggctaagcgcaggctaagcgtaggtccatgtttaaagtatccaagagaatatccacgaagcggctgagcaacgaacagaatcctggttctcctcgactaagcagatagttaagatactgtgcaccatggaaattgaaaacgaacgtacgtaccgactactttatttttgcaggccggaaatcaagcgatgaatgagacatccttctgttttctatgttgtgcttgaaggggacagacagtcgcttatcttagtgagattttgtttgcttttgctgcacctgcatagcgcagattctgcatcttctcaatagcttaattattacattcttagatgatgataagacggaaactggagaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacgtttgttgaagacgaaccagatttccagggcggaccaatcccttcaaacaaaccacgtgatggtctacacgttgtttcaagtgcatactttgaaattcaatagaaaggattacgataccctttctcttttttacctcaacagaggatactataatgagttgagtttccgtgtcctggaacgttgtcacgaaaaagcgagtgctaggccgaacgacagctctacgatgcgtactttcactgactttgtttccggcgcacctattgtaaggagtcttcagaaaagtaccataaggaaatatgggtacaatttggcaccctacatgtttttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatattttgcatattatcttgcgagcatgtgcgctcaatttcggggcgggtccccgtggtggcgctggtgacgaagaggatcgatccattacgaatgaagaacccattattccctctgtggacgagcatggcttgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcgatgtggaaatggatcaaaattctgtaccacgaagtagcgcaggaaaccgcgctgaaggactcttatagaataactttggtaccttcttctgatggtgtatcagtatgtggaaaactgtttaatcgcgagtatgtccgcggcttttactttgcatgcaaggctcagtttgataacctttgggaagaattgaacgactgcttttatatgcctacagtggttgatattgccagcctcattttgcgtaatcgagaagttttgttcagagagccaaagcgaggaattgacgagtatctggagaacgattctttccttcaaatgatacctgttaaatatcgtgaaattgtgctgcccaagttgagaagagatactaacaaaatgaccgcggctcttaaaaataaagtcactgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatcatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctgcaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatatattattatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgctgtagggctaaagaacagggtttcattttcattttttttttt

SEQ ID NO: 12209 - DNA, 270148 bp, Saccharomyces cerevisiae
gatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttctcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatactccctctgggcagaagtatacgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtgctggcagtggtagtagcattagtcctgacgttgatgctggcagtggtagtcgcactagtcctgacgttgatgctggcagtggtagtcgcattagtgctggagttggtactttcagtggtagtagcactagtcctgacgttgatgctggcagtggtagtagcactagtcctgacgttggtgctggcagtggtagtagcattagtgctggagttggtagtcgcattggtactggcattggtagtcgcattggtactggcattggtactggcattggtagtcgcattagtactagcattggtagtcgcattagtcctgacgttggtactagcagtggtaatcgcattagtactggcgttagtactggcattagcactaccatgaatgcacgtgtcgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacacagcatccaacatgctggcccttttttcctttctttgattcaagtccatagaactcgcgtacctgttcggttatacagccttccttaattggtggtaattcacccttacgattccttgccgcccaactgttttttctagataatagataacagaggcccccatctcttagtctccctacaccttgaatgagctcaataatattaagtctattatcaagcatgatcaccatcatcaattgcttaatgtcaattccttcagtcactaatttcgttccgatgagaacttgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgtaaccttcttcaataaagtttcttacaggggccacattcaagcaaccgcgtcggcccaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacacgcaaaacatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtggggtgccaaattgtacccatatttccttatggtgcttttctgaagactccttacaataggtgcgccagaaacaaagtcagtgaaagtacgcatcgtagagctgtcgttcggcctggcactcgctatttcgtgacaacgttccaggacacggaaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaatgtcaggaacttttgtacatttttcccgaccatgacggaaatgacaattttttcaaaagaccttttcctattcattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctccagcagcagcaaagaaaattcagttaataagaaatctcactaagataagcgactgtctgtccccttcaagcacaacatagaaaacagaaggatgtctcattcatcgcttgatttccggcctgcaaaaataaagtagtcggtacgcactttcgttttcaatttccatggtgcacagtatcttaactatctgcttagtcgaggagaaccaggattcgtggatattctcttggatacttcaaacatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcccaatcgcctaaacaggaaatattgcctattttcgtacaaggttacttcctagatgctatatgtccctacggccttgtctaacaccatccagcatgcaatacagtgacatatatatacccacacacccacacacaccacacccacacacccacacccacacaccacacccacaccacacccacacaccacacccacaccacaccacacccacaccacacccaccacacccacacccacacaccacacccacaccctaattctacctcaaccctaccctaatccaacccttccatcctgtctctcaacttaccctccattaccctgcctccccactcgttaccctgcctccccaccaccaacccacaaatccaccataacagttaccctccaattacccatatccaacctcactgccacttaccctgccattaccctaccatccaccatgtcctactcactgtactgttgttctaccctccatattgaaacgttaacaaatgatcgtaaacaatgcacacatacttaccctgccaataccctaccatgccccatctgtcatactcaccatcacttgtatactgatacggcatacgcacacggatgctacaatagtatatactatctcaacttaccctactttcacattccactccatggcccatctctcacttcatgagtacaaatgcacccacatcattatgcacggcacttgcctcagcggtctataccctgtgccatttacgcataactcccactattatccacattttaatatttatatcttattccgcggccccaaatattgtataaatgcccttaatacatacgttatacctctttttcaccgtatactaaccactcaatttatatacacttatgccaatattacaaaaaaatcaccactaaaatcacctaaacataaaaatattctatccttcaacaataatacataaacacactcaattgcgtatcaataccaccatgaggtcattaacttaaatgttccttaataccgtcataccactatgctctattccatatattgtaatataactgtactctatagtcatacagacgcttttacttcaccctatcttctcatactattgtcatagaatcgcacactgacgcatgattaaaacgaataatttttactataaggcctcccatccgtgctctatccttttgtttgaaacatttatatacagaatctcaaagcaagcgggagaagtagtaattacccagaggtcatgcatgatcttagcaccaccgtacctctaagttttgctttgagcctttttacagtgacatcaaacataaggagaaaaaatggtattgaaaggttatcaatatagggaaataaattggttctatgaatcttcatgtaagatactcgtaggacagactctttcctgtgtaaatatttgtgacagctacgtctattttctattagatatttacacatttttgtcacaggcaatctacgcttaaaatatacgtttcattttgggtaacaactgctgtgcgaacagtgacattgctggtcgcaccttaaatgtaaaccaaagttacggcacaccgtgatgtaccctcatacaaagctttgtaaaagtattattacgattatcgagtaacttagatagaaaaccggaaatgaaatggactcccttttcgaatagtagagtttctgtgcctaaaatagcccaacattgttgccctttttctatcacgaggttactgagccattgcatgaacgcgcgcgcctcggcggcttttttttctactctataaaagcgaaaagccagaagttactatctcgaataaaaaacccctcgaactgccatctcattaccgaaaatgaaagaaaatgaacttaaaaatgagaaaagtgtagatgtattatctttcaaacagctcgaatctcaaaagattgttctacctcaagatcttttcagaagcagctttacctggttttgttatgaaatttacaagtccttagcgtttcgcatctggatgctattatggctaccacttagcgtctggtggaagctttccaacaattggatttacccgcttatggtttcacttcttgtcctgttttggggaccagtatttgttcttgttatttttagactttctcgtaaacgttccttatcgaaacaactcactcagttttgcaaagagattactaaaagcacaccaagttcggatcctcatgattgggaagttgttgcagcaaatctaaattcgtacttatatgaaaataaggcttggaatattaggtactttttcttcaatgccatgggctgccaagaagcgttcagaacaacccttctcgaacccttctctttgaaaaaagacgaagctgccaaggttaagtcatttaaggattccgtcccttacattgaagaagcattgggagtttattttagagaagttgaaaaacaatggaagttgtttaattctgagaaatcatggagccctgttggcctggaagatgctaaacttcccaaggaagcttaccgatttaagcttacttggtttttaaagaggatttccaatatttttatgttgataccattccttaattttttgtgctgcatatatgtgtcacggggaatgtgccttctattacgcaccttgtatctcgggtggattcttttcatgttggtacaaggtttccaaaatataagggttttgattatgagcatggaacacaagatgcagttcttgtcgactattataaatgagcaagaaagtggtgcgaatggatgggacgaaattgcaaggaaaatgaataggtacttgtttgagaaaaaagtctggaagaatgaagagtttttctttgacgggattgactgtgaatggttttttagccacttcttctaccgcgttctatctgcgaagaaatctatgcgggctctatcattgaatgtggaactatggccatatattaaagaagcgcaattatcctgcagtgaggagtccttagcgtaaagataaatacaactttttcaatttatatattttgtagtttgtcagctgcgaataaccaaaacgagactactttttacgattacaaccattctctttttccctatttctcactggttgacagaaatcagtgtgctatcatcctaccatatgcgcaaaacttattgtctttctcctcctagagatgctgtattccatgcatattctgaacgatgggttggtgtttttatcaagcaaggttaatcacatggcgtggcttgctccacgcatcagtagaaaacgcataccgcagcggaatccttaaataataagtgattttactgttcatcaactacaatcggactctttcacaattacccttcttgttttccacatttactgttaaatgaagggatgtacagaaggcttaggaaaacctgtgctgaatactggatggacactgcattcccacagtgaagcttttatagatacactgccagttattttcgaactttcatcaagttgctgagttttagtatccctttgccttagctatatgtttgaatgagcaaaatatttgcaatgtctctagctttcttgaaatattggtttatattgagggcttggtaagatttcaaatttcattttgaagtgctcaggagaaaaatcatgctcttttgataatttggtgactaaacatacataaaacagtttaattttgggtggtaatggctgtgtgactagctatagaaagaaaaaaattaaaaaaaaaaaaaaaaatcaagtagttcctgcactgcgacgtccattatagcattataaattggtccctgatttacgcatgcgataaactatttttagcgcagccgcatattatccgagaataacttccgacataagaaaattcgcagaaaatagataaaaaaactgctcttggcattcttcacttcctctattacacactgtgtcataccacaatcatctcacagtatgtatttgtatgtttatacatgctataacgtaaaacaatgtagaatatatatctaaatacctcacggttttagtttagtgcagcccacatactacttttttccttttgttttttttttttatatttcaaaggttaaactcgcttagactatgtctataatataaaaaaaaaatagctctattccgtttcttttattctatttgatatttccatcacactttcatcttaatcacggatgtatactgataatagggttgactgcgcctgtacggattacagtgccctcttcaattggaaaatccaagctttcaagatgggtaactgttattcaaaggatcctctaagataaaacacagatcgacagatccgagagttggcttctgtgccttgggctcaaattcctttcccacctcatgcaaattgatttttctgactccaaaaaaagacagagccctgcgatagttcccgaatgttgtaacatcaaagccaagcactcctttatagaagtcgcatgaacgttgaatactagcagctggtgaaactacagggtctaaactaactagtatccatatctttttgagagcattgaaagtatacggagtacaagctgggttagaaggaatttttatcttaacagcaatgaaaatcaactttctagactgaatccctcaagaaaattgcaaaagactaactgatactggtttaaaagagaaagatgtcaaatatgcggagttataccatcaaacaactttggacggccccgaaacaaatgtccgcaaaaaagatcttattaaagtgcatggacactatcatttctataatacaaaatactccaccgcacaatagtttgtcgggaagtcatcaatcaatcttgtacgagctttacaaataactttttaggatcggtcccctcataaaattatatataaatgggttagtttccttcttcttctgttaacatgaagttgcttcgtactgttttttgccttgcttctcttcaaaagaatcaatcatgtcacagtacggatttgtaagagttcctagagaggtagaaaaggccattccagtggtgaatgcacctagaccacgggccgttgttccgcctccaaacagtgaaactgctaggcttgttcgggaatatgccgctaaagaattgactgcccccgttctaaaccactctttgcgtgtttttcaatatagtgtagctatcataagagaccaatttccagcatgggacttggatcaggaagttttgtacgtcacctgcttacttcatgatattgcaacaacagataagaatatgagagccacgaagatgtcatttgagtattatggtggcatactttcaagggagcttgtatttaatgcgacaggtggaaatcaggactatgcagatgcagtaactgaggccatcattcgtcaccaggatttgactgggactggctacattaccaccttggggctcattctgcagattgctactacgcttgacaatgtcggatccaataccgatctgattcatatcgatacagttagtgccattaacgagcaatttccaagactgcactggttatcatgttttgctacggtggtggacactgaaaactcgagaaaaccgtggggccacaccagttctttgggtgatgatttttcaaagaaagtcatatgcaatacatttgggtataactaaataggtaagtttcaatgaggcgagttcagaatgaacagtgatgatctcctttctccataactatactatacgtcccttttatttactgtagtttttaagaacaaattctctgatgaaccagtcgtgaaaccgtatatcgttttctgccaattccggatgaaatgatgtcgcaagaatattgtttttttgcttagcggcaacaattagttcttgaccaccattatccttcccatctaatttgtacaggacctgcacatgttcaggatccagcacctcttctattactggggctcttataaaagtagcaggaaaatcattgcagtgaggaataaagtttgaaaagtcgcaaatccgggtagaagactgagcttgtctcccaaatgcatttctttttactttaacctttagtaaattcagcgtcttgaccagttttgcttcgttagataattgttgtgaaatataaatcaaacctgcacaagtaccccaggttaccttgcttgggttgtgtacgaatgcgtagagatcgtcgtaaaatcctgttctttctgcaataagggacattgcagtcgactctcccccaggtatgatcaatgcatcacattgagctagttgatttttatccttcactgtcatcacagatagttttttttcatagaaatccctgttttcgacgatgcatttttctacgtgtcgcacatgttcaatgaacgcaccctgtaatgccaagactccgataacgacggtcatttttgagatattactcttgtcttggccccagcaaccagggtcatggtaagtgtgcttgctactcaaacagaaaaaaatgggcttttatcaatgaataacttttttttttttttgtagctgaatgatgaaagatggctcaactattcttacagtttccaataaagtgacgcgccgcccaatggcataacagtagtaggcacattatatcgtttgaatggcaaaatgttgtggcaaggaaagagcagaattatttgttcatgtggaatgaatttcacacacacacacacacatatataaaactagtatgtttctccaccatagtcacattattattcgacccttctgggaaaggaactataatagaaaaataagtatatcgtaaaaaagacaaaaatgtcagaattcaaggttaaaactgggcttgcccaaatgttaaagggcggtgtgattatggacgtcgtcacacctgaacaggctattatcgcagaaagagcgggcgcttgtgctgtaatggcattggaacgcattccagctgacatgcgcaagtctggccaagtatgccgtatgtcagatcctcgcatgatcaaagaaattatggaagctgtttcaattccggtgatggcaaaggtccgtattggacacttcgtggaggcacagatcctggaagagctgcaagtagactacattgacgaaagtgaggttttgactccagctgattggacacatcacattgagaagcataacttcaaggtgccatttgtttgcggtgccaaggatctaggtgaggctttgagaagaataaacgaaggtgctgcaatgatccgtaccaaaggtgaagcaggtaccggtgacgtttccgaggccgtcaagcacatcaccaagattaaggcggagatccagcagtataaagagaatttgaagaccgaatccgattttgcagctaaggccacagaattacgcgtccctgtcgacttgctgaagacaacactatcagagggaaagctacctgtagtcaattttgctgctggtggagttgctactccagcagacgctgctctattgatgcaattgggttgtgaaggtgttttcgtcggctcaggtatattcaaatcgtcagatcctgagaagttagcatgtgctatcgttgaagccacgactcactacgataacccagcaaaactattgcaagtttccagcgatttgggtgacttgatgggtggtatttccatccaatcaattaatgaagcaggaggcaaaaacggtgcaagactttctgaaatcggatggtagaactagcgatgctcacacaacgctaatttgtttccttcgaaggggcagtcggctattgtagtttctatatattatgtagcacaacatggaaaccatattcagccagtttgtatatatgagaattaaacgttaaaactttttcatcctatcagtctttcacattggccttgcctaaagggcacaatcgttcacgtatatacatatgtatgtttacgtatatatatatgtgtttacaaatatgcatgtatattcttttcgaggaagattattatatgctattaggcgatgagtcggcttaattttttagggggacgagattggcgcgttagtgcataaagacagcaaatcacctggaggtgacaacattaatgcatttatcggtttttggctatgatgcaatgagtacagttccaattgaacggctcatgaactatgaaatatacgaattattcaactagcagaaggcttgaaatattacttattcagattatgaaaatggtgctgttatagcaaaataagcaacatcaatctcttgcgacgacagcaaacaaaacatataaaaacctcgtattatcatcttcatgaacaatattcttgtccattcttttgttcttttaccttttcaattttataaaaataccacaacaacaataaacacacttccaagctatgtctacagacaagatcacatttttgttgaactggcaaccaaccccataccatattccaattttcttggctcaaaccaaaggttacttcaaggagcaaggtctagacatggccatcctagaaccaaccaatccttccgatgtcactgagttaattggatctggtaaggtcgacatgggtttgaaagccatgatccacaccttggctgccaaggcccgtggtttcccagtgacctctgttgcctctttgttggacgaaccatttaccggtgtcttgtacttaaagggcagtggtatcactgaagacttccagtccctaaagggtaagaagatcggttacgttggtgaattcggtaagatccaaatcgatgaattgaccaagcactacggtatgaagccagaagactacaccgccgtcagatgtggtatgaatgtcgccaagtacatcatcgaaggtaagattgatgccggtattggtatcgaatgtatgcaacaagtcgaattggaagagtacttggccaagcaaggcagaccagcttctgatgctaaaatgttgagaattgacaagttggcttgcttgggttgctgttgcttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcaattgaacaacgatctatcctacaagcaataccaaagatgttacgcttacttctcttcatctttgtacaatgttcaccgtgactggaagaaggttaccggttacggtaagagattagccatcttgccaccagactatgtctcgaactacactaatgaatacttgtcctggccagaaccagaagaggtttctgatcctttggaagctcaaagattgatggctattcatcaagaaaaatgcagacaggaaggtactttcaagagattggctcttccagcttaaacgcacttcgtcactcctcgagcgcagccttcctctacgacttgtgtatgatttcacattaggttttttttcctccctgatatttagatatttactattaagatattatttatgagccttttattacagcttcttttcccttgtaattattgtacttgcctccaagtatcgaaagtcttgcgttgcctcaatttgccacttcaaatactgtaatctgcacaatttacgtccgaaatagatgagggataaaagctgtttttaagtacggcttattcaaaagtataaaagtagagagcatagaatatataagggcatatttcttacacaaacgcaccaaaaaaaaaaaaatctgattaatcgaaggaaatctgcgcagacattgccgtgagaagtgaagccttcttggtaacagccggatcatcaccgataaaattagtaggaaaaccaacatcaaaaggaataatactttctaagtactttatttgttctggtgttaatttaatgctcaaagcctcaatgttctgtttgaggtgttcaattttccttcctccaaccaatggaaaaacatttttcgccttagagcgaacataggcaatagcaatagcagtaacagattcagtgccatgttcctcagcaaccttggccaatgcttcactaatcttgatttctgcatctgtttgttcagaggcgccaacgaaagaacgaataccctctccattcttcctccgttcctccattgcttttttactctgaaatcttccacctcccatgacatcccatggggcgagggccataccgaaatgcctagccattggaatgatatcacgttcgaagtctctgttcaacaggttccatttaccttgatagatgctaaaaggggttttaccatgagatttagcgtagtaatttgccgcagaaacaacccaggcaggcgtatcagacacacccaaatagaggaccttgcctgctgcactagaatgtgtaaactatccataacttcttcgatagaactcatataatcccaccagtgaacgtaaagtatatcaatccaatcagtttgcaatttgcggagagaatccctcacactcacatgcaaactacgcttgtgattgccacagtagtttgcgcttttaccaccaccaacgtcgtatttcttatagtcagtggtaaacttggtggcgattacaatctggtcgcgtaattttcttgaaaccatccattcaccgatccaagcttctgactgttcgttttgataattatttgcagtatcaatgaaatttccacctgcctcataaaaagcatcgagcaactcaaaagctcgctccttgctcattgatcctaggatttcagaccaagcgtcgccaattgacattcctcccaaaatgagaggggaaactctaataccagcacttttagaaagaactctgagacgtcctaactctgtagatggttcaggagcaggagcaaataaatcagccatattaaaaatcgctattgaaaatgatatagaagagatattcagttagtactgaatttatatcgattgattgactgatttaggttgaacagagaggaaattgtttctcattgcgacggtattgctccttttatatgtctgaagattgagtgcttattttctcgaatttgtgcacgtgaaaacggtgaacgtggttgtataccttcgatacggatttgcttactaattgagagcaaaattagtaagcgaaatgtgaaaattggcttacgaattagccactgcatgttctacggtttccacaacaaaactgcaagaacctgtgttgattcggaacggtactatctcttcgtaatatcaaagttcattttgcgttactccatcctagtaattctttcagattccatttgaaaaggctaaagattctataggagcggtggcaaaccagaaagtctaaatattgttatcaatccgtgcgttgttttgctttttaaaaccagcaaggcaagcagatgcaatatagatctttacggcttcctgtacgcacattttaaactcgacaagccagctccttctcctgttcacgccctctacgaaccatgtgattattagcactgtatttgagaacaggtcggtgtatcattttctacaattttgtacatagaaaattaaatgccggatgattgcgattatcaattacttagcccttgattaaagtcacgctttcaccaaatatgtgctcctgcgcacttcttttctgccatcttttttttattattttttattgattcccacatagaatccttttcattaacaatgtgaaaccaaagaagagtagtaggttcacgttatgtctctctttagcatatgtctctctttagcatcgccaaaatatgatttcaaaatccttgagcctattataccacgttccaaaacttggccaaaacaatgctacaaaaagcgatggacttaatgctataggagtctggttactggctgcaagtgaattcttcacccaactaagcagctttctattagaaaatatgtttatataggtctaaaccgtcatactattagtgctggcttgaaggatggtattattatttgtcaggtgtttttcttaacctacgaaaaccaaagaagcctcagttttttttttcctcctttgatccgaatcgagtaggagtacttaacgagttgaaaagttttcaattccttgttaccaaaggacacattctaacaaagcaaaagtcctcatacagacttgacgggatatttctttctatataaaaacttctcaaaaagttttttaccacaactgtggcaatgttaacgctttttgtcgaagtagtgtagcgtagcgccacactattcaaggatacatagtaaatcagagaaaggttatcttgtaagcatacatattactggagatcatgtttccggagtaactccgctggtatttctactaagctggatcgttactatataattgatggattctgctaatagattccactctttttgtcagttctcccctcattgctctgaaaatatacaagatttcagcaatcctcgctaatggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctgaccattattgtgaatataagctatttgagaattattttacctttttacagccgcccccccaggataaatatttcaagttgtggtaacggaaaagggccttacatactctagtgagcataacacgtacaatgaaactatgattaagtcttctgcgctttttagagccgatgtaaaaaaacatgcttttttataaccaatgcatgaagtataatttaggccccttttgagttaaactactcagtgtcgaacacaagtttgagatttcgcagtcaatttttgggttgactcgattatttgctttgcaaacttcttgatgagtggttcattgcaaggatgatttgtttttgttatttcttattaaggatatgtaagatggtataaataaagaaagtcgtttatgaaagagaaaagaaagaagaagaaaaatcaaatttacggcaaaaacaataaatcaatgttaaagcactagtaattgccggatgaaaaggttcagaaattggttgcggaacgtttttacgccggccagggtttttcatagaccatttatgagatattatacagcaatattctagcacaaaagataatcaacccgaaatatcaatttcatagggtataaacccaagaacctcttgaccggtgactttttctccgagttatattctagaccaagcacctcttttcacctagcacatcttatcctgttcctgaaaaatacagtttatacgagcttgcgtgttttccaaagaaaagagcaaatgcaagattcaagattactgttcttgttttatttgcacttatccaatcaaaagctcgtttagggattgtagaagagctgactattgtagttaaatattaggggaaatgaatatattttatcatgggaaatacgtggaacgtgtaatatgttgttgctgctcccaaaataaatttacctgacgaaaaccttatatttccggaaaaaaaagcttaaagataaaaggttaattgtacttttaaactcttgcggaatctctgtgctcggagaaaaatatcctggaaaagaagatgcggggtaggcggacttaaaagataagtgcacatttttccggacttcgagtggcgacagacagcctgttaactatttttgagaataattaatctttaggggggttttagtaaaacaaacaaaagactcaaaataacgccaagaacatccgaagaagtcctggtcgcgctttttgctgaggtggctttaaaaaactagtttgctgagagatgtaataatggctttaacagataattcctcgtttggccacattatcaaaaggcaacctctttctgaaaacggtatagccggaaatgactgccgagttatattattgttcggtatactcaagttattggtacgaaatatacgataagaatctaccgaattttcatccatttagtgagaacgttgggtgaattgaaaaaggtgatagatttttctgctttggccttggattagccaaagtatcaatccttaaaatatttgctggcagtgtgatttttgcccctatctgagcaaattttgttatctttttcaacgtcaggctgaaattgacaacttgagtaacgtaaatcaatatggcacttctccaatttatatcgcatgagaaaaatagcattggtcaatcatacagaacgtaacatcaaaaaacaaccgtttacatatatataatcacttgtctaaaattgattgaaattgcatatgagaaaatatatgataatgacaataattttctttgagcacaattagtttatttggcaacttgctctttattattagtaaatatagcacatattcatataaaacacatcttcagtgggattacctagttgatggtgccaggaattttcctatcgtcaacgagctgaaaattttattatttttattaataacataatgtgagactcctggtttgacatttaattttacgtattagtcgaattttgttcttgcctacaataaaaagacaattaagccgcaggcagtctcattctttattacaaaaacaaaacgatagaatttagagcacaagtaagagatggtaacaaagtcacggctcccggatgtagtatgtcgtcaaataataagttcgtgaaattaataattaggttataaatcgtaaaaaattgaaaatattaattatgacgaagtaggcacagatttcttgctgccagtgttgctgttgctgttaacaccagattcatctgagacagtgccatcattctggtggaactccgcatgtaaaagtttacctaccctattctcaatataaccgttgtctgggtagttgactggggattcgcatccagtaaaaatgaaaatgtcatatatgagtgctccagcaataccgccggcaattggaccaccccaggctccccatgtccaccaccaatgtgtgagatgaaaagcatgtggaccatagccaatcatggaagcaaatatgcgaggaccgagatctcttgcaggattgattgtgaaacttgtttgatatccaagggccataccaattgcagcgactaagaatccaataattaatgcggtcataccattgccaggtggagcattactatcatccaatagcgccatcaaacaacccacaagtatagaggctcctatgaattcgtcaaagaaggcatttctccacgtgacgtaagactttggatcagtaaacaaacacgcaccggtcgccgttgttcttatgtgcggacctccctcaaattctgtgatagagctccaaaaataaccataagccatagctcctccaaaatatgcaccgataatctgagcaacaatatatacgggcacctttttccaggggaattttcgaaaaattgccattgaaatcgtaacagcagggttaatatgaccaccactaataccgcctgcgacgtaaacaccaagcatacaaccgaacccccatgcaaatgatagggattcataggaaccaccactaccttttgttacagttgcttgaagattaccaccaacaccaaaaatgacaagaactagtgtcccgagaaactccgcaaacggttctcgcatatgatagcgaatttttgcccaaaagttaggaaatgtcattatatccgcgtcttcatcttctgaggcaccaatttcattaccatctaatgcactcgtacttttattttcctcttcaataagttcttcaggaagcttcgtataaaccggagtagaaccatcgagggtttgcatgttctttaattttctggattctgcatcggctatggaggatgcgtagctttcatcgcctaatgaaaaattgacattatgcgaagtacgctttttcttacgtgaaacattctcaatatgcgtgttagagggcttttgtgggttttcaggctctaacttagtaggtttcacatctgcaccaacagtattatcgcgttgcgtttgagcttcgatgtcaccaagctttttacccggtgctgcacctctaaggagccttttccagtctttcactgacgtagtagaacccccccttgaaatatcggtcgaccctcgtctcgatgatgcgcgggaccttgcatccatattcttttgtatcatctttgctgccaagcctcgatccaatacatgcggtaacggctgatttaaactccaaacaggcctgttcctgctactacccatagttggatttaattgccgatatagtgggtctacataattattactgttgccttgatttacccccctggatagataatcttgcattatacgtgcttgctcagcatctgaaaaactgtttaaagtcttcaaattaggcaaagaataagtaaaacccatggaagggacctgtggttgtaccgaatccttcctctcgtcaaccacttttttcaagggtgtcaaagcagaaagtttatttctcgatgatcctccagtttcaattgcttttcgagtctcacctagctttcgcctcaagagagtgctgtcattttcgttattttccctagattttttgacactttcttcccaagctattttaccattaggttcttcttttagcgttggtggccgtgtactctcggaagaggaggatgacctcccagattcgtaactcattacttgggtctagatcatatatcagaggagcgttatactgtgcgattatacgcttctttttatatgaataagggggagacatggtgaaaaggtaccagaacttttgatcgaccaagactaggtaaagctcaaacaacgtttataactcaaatttccggggtaagtggggtaccggaaaattatgatattccggagcggagttatcaacggagaaaactaggccttctgatggaacttaatttaaaaaattaatcacaacctatgcatattattcccgcagagggtgattgtgagtaaatccctgcacagaaacaattcccgccaggccataactagattctaaattatttaactcataatttcatgaaatcgtatcgtagtaccaaatagggagatattgagccaagtaaattcttacgtcaccatagttggataattaagtacttgatattgtataaggatctcaacaatacgagaaggggaaaataccgcaatgtgtgattgaattttcaaactttggatcattaaatatatataaatgaacccagatcagccctttttttttctagtattgtctgtaaagtgtattttacctcaaaatctgacaaaacccaactacaattgactaaataatcatgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactagaattgctcgtacacactagaagccaaacataacagctttaaaggctttcatttttgaactttttaaaaaattgaatactccaactgaaggtgaactagttgtgtctctgaatatatttttatagatatacgaattgatgaagtaccgcaaattaagctaaaaagtaatgcttcttgcagcttttaattgttctttctgcaatctacaattacttttcttgattccttctccgttcccctgtgttgtctggaagtataatttgtccaggaagattttttgaatagccattgttttctttaaattaaatcggagtgtttaaatccattccaatctcttttttctcgcaagtcaacaaacaggtgttaactttcttttccccgctgttttcttacctatgaatagtctcaattcctttttagaagatctgcacattctctgatactatgaacaagttctaggatagcaatctaagttttatgattctcttatttcggattcgatttcaataaagatcgtagtattagaagtatagaatgtattgtaattttttttcctaatcttattaattcatggaaggcattgaactcaacagcatattttaaatgtttgtatcttgttttctctttcaaaaaaaaaatggtgtcattcattattttatggtcaaccctatacatcaatttttctctgaaaatattgacaaataaagtagttgattcttgttctaccaattagtgatattatgcatgactgttaacaactttttgactaatctctgaaatcatatgaagatcttgctgcatttcatgcatctaagaaatcaacctatatcaacagatttcaataattactctaaacttatgctgtaacttagaaagtaaccagcctgtgttgactgattgagttgcgtattaactgcgcctagtcatttcaacacttataatttgcttcagcttaagtgtggttcatctttttttttctggaaactttgcatgccctcaaagcatgagtagttagttatctttttgacaatgatctcttttgaaaatatctactgtagatttgcatggacgcacgtcgcccatacgccaaactttggcaatgatactcgttattcgtaatatcagtccgtcaaggtgctgtgatttctctattttatattgcctattattttttcaaatgatttgagccgttttaaattgagtatgcaatgagtcttttgaatcaaccgtaaggcagttccataaccactgccacgaatacgtttcactaccttgaagaatctctaatgtaggccgtattcttcgcacttagttctgacgatgtagacatctcattatataagagcataagcgcctgtttctagaatcatttcttcgtgacccagctttttgagttatttcgcggtattttgaaacatttctcgagcttgacgtgaacatccttatatttcatgacaaactcgatcattggaacatccctgcctcgattttagagctagtatcaaatttcaatctctttgtgatggagccccgctcctatttcaaaagagaagtttcttgtatgcatatgttattgaagtctgattatagcaagtgcaatgtcgtctcaattattttaactatttttagccatacatgttagttatcctcaaagagagcctccagactgggaagcagtgtttgtcatttcaaataagtagatttcacagtttgtatgattttcgaagccaggattcattgggctttgagtaaagagaagccgcgtattacgaacagcttacgatattgtaaaatattcccttattgtggtgccccaatggatacatgccagagaaatgtctgtgaaattgaacaattacaatgacgagagcaagtaatccggcggccttgtctctctttcactagtaccgtctatatctcttgagcgccaatatgcgaaagctttcacaaggttgatgttcatggtattcggcgtcgatagcgaattgcttactaagaaacattagggtgcagtacagccttgtttttccagttcgactaacctttttcttggcagtatggagactgactaggtctcccaaacattcattgtaactgctgtttaaagattttgttctaacctaaattcaagtgagaagctgaacatgtgtctctacttatgatatcacgacagcaaatactaatcttgccataaatagtctagcgttttgcaacttacctctagatatattttatttcttgaggaaccgttttcgtcggtaataacaaaatactactgaaacgccacagcattgagagaatacgttatcgattacggctttcttctcgctccagatgtcgcgggtaagatattcacctcaaacttttcttgttgagtgtcgtcacaaatctagaacctacatgccatctcaacgatttttctggagaaaggcctcactccgttccgtacgtaatgcatagataaagtatcaggatcttcacgatgctcgagagttacttagtagtctgagtttatgcgaaaaaaactccgccgttgtaataatcgggaatacacagaagtagtactgcactatcactgggatactcaaaaaccttctttttaacttttctatcccacaaatagaacataggaaagaacattgactcctccacttgaagttaaattacaggaacaaacgcctaactataatttcgacattgttgcatcaacgaatcgaccgaaagaaaaatctggagttgcagttatcacttgtatgtgcactaagatttatatttttactcctgagatctgccaaatcggtagcttattgaactgcgttcctttttcccctgagttctcgaggtacctgcggctttgtctgtgccatctcccccactttaaagtaccccacgttactaccgcgtttttccccacccccggcttaataaattagctatatcttgttgacttaaatacggagaaaagaagaaaaccttcaagaaatgcttcattgtcttgtcaaaagagctaaagtaaaagagctctagttcgaagatggcccgcaatagacaagcgtgcgactgttgttgcattcgtcgagtaaagtgtgatcgtaaaaaaccatgtaaatgttgtcttcaacacaatctgcaatgtacatatcttcgacctttgaagaaaagaggtccaaaacccgtcaaggtgagaaatttaaagaaagtagatgatgtacaggtatttagtaaaagtagtagtggtggcataatgaaggttccaaaggcactaattgatcagtgtctgcggctctataatgataagttgtatgtgatctggcctttgctgtgttatgatgatctttacgaacttttagagaaaagatatgacgaaacctgtgtgtattggttcctggtatctctttctgccgccacgcttagcgatttgcagactgaaattgagtcggaaggaggggttacctttactgggatacagttatccagtttctgcatgtcatcacgccaagaatttgacgattttaacggtagtgatatattcaagattatgacgtactattgtctaaaccgctgctacgcacagatgtccaactcaagaacttcgtatcggctttcttgtgaagccgtggggctcattaagttggcggggttccatcgcgaggaaactttgaaacttcttcctttcgatgagcagcagcttggaaggaaagtttattatttgcttctcttaacggaaagatacttttctgtgtatacgcattgcgccacgagcctggataccacgattgctccaccacaaccggagaacgtaacggacccccgactatctctcgacagcttcttggagatgattagggtatttactgtaccgggaaaatgcttctttgatgctctagctaccgactctgctaatgtaacctgtactgaagactcccttaaaaagatatggagggaacttcatacggtgccacttgagatagaaccatggtcttacggctatgtagacatatctttttcacggcattggattagaacacttgcttggaagctagtgcttcaaataagcggtatgcgaatcagtttcctttcaaatagcaagaatacgcatattccagtagaaattgctagagacatgttagaagacacatttttaatcccaaaaaatctttatgcagttcacggtccagggatatcagtgaaagcactagaaatagccgacgcattggtagatgttgtgaatcagtacgatcaaaatgcagagtcggaggcttggaattttttgttcgatatatccaaatttgtcttctctcttaagcattgtgatagcacattagttgataagtttacgacaaagtgtcagtgtgcgcttatcacgcttcctctttctaatccgcttgaatcgacagatggttctaaagaagatgtagatgcgcttccttaagtaaacacattgctacttgcattttacctttcaagatgtagtgattacggacagttgaagaggctaatagcatctatttcttctttagtatatggttcctgcagggcaaacaattatttcctttgcaattttgcggcagtggggaagaatgatagcactaatagtgaacttgtggacaattatgctattatagcaagaaaaaaaatttatttttttttcaaggggggtgattgtgatgtgaattaaatcaaggatatacgcttttatcgtcatgatagtcgtgcgatttgtacttggttatagatgaaatgagttagtttttaataattgtgatcacaatatagctgtacttatcaggccattaaagtttcctgtaaggtgcacgagaagtcatggtcataaaattatcagaatctccaaggagaggttcaacggcgtcggttgcccatactccatattaagtaccctgtcatttccacagttacattagttggagtagtatagaaaccaaaaagatcagaactccaataggcagtatttgggtcacagtattcagtgtcacgttttttagtttcataaagaggtccgcaaggatcatatccatcctcatcacgcttcaaaactgcataagtcacacaggtaggagtgctctcacaaggcggactatagtatatggagagattggtctgtccgctaacggaacctaacttctttgtattggagtattcatagcccatatattcaggctccaagtatgtggtttggtcgcctattgtgtactcataaaaattaatattcataccatcttcccttttgtttgttggtaagcaagcttctgtactggctaaggttgtagtagctagcgccacgaagaccaagagtgccgaaaatacggaatggggtatagacatttgaaggtgtggagggatgctggtatcctccaattgttacattaagattatcatctggctatcatgaaatgaaggttacctttatataagaaagacttttaaaaaaatgttttgttttctgctttagggaagtagatatcgttcctgcattttgatatcaaaataatctccggtaggcatcaattgcagttaaagctctttctggcaaaaaccccgatacccatgtaggtacgctcttttcaccaggtcttaataatttgatgggcaccgtttatcccaggcaagccaaaaattagaaacaaaaaacaactcacgtacgttaaaaaacctgatagtgcttcgtactacatagaaccctgcgctgttatctgctaatcgagcactactaaattccctccaaaggaagtagagtatagattctatgcaccgatgtgaaaatagtaaacctacgataacctttttttttttactaaccgaattgagcagatattgttacctgttacggtcataaaagttaaacgattttgctttatttctgtccctggctgaaaatagtaaagaagagggaaggcaagttcaagggcagcttaataagtcatacgaaaacgttctcgaactttttttctgcaagcttttcagaaccacgatggaaaaaagaaatttttacaacactaatgccaagtaaggtttttcggatttagggtggcgtcctgaaaaaaaaagaaacgtctcagaacgtttcggagaaaaaaaaataaggtgtcaaatttcttagtgttttgacgggtgatgcccttccagataaatctcgtggagattggctagcgtcaaacgtcaccgatctctatttcttttttaggttattaaatttcgattacatcgcgtgttcttagataagttaccaagggtgctcaaaggaaaattatatttctttttttcttttgagtaattgcaggtgaagagatacagagcaaggaacgtgatgtaatgcatttttttttttgttccttggaaccacatgatttactcaacaaattaatctagtttgtgcttcaagcatgcaccattgtgaatatttttttagtttcaaggtgacaggttatgaagatatggtgcaaaagacaaatgtatggtggcaggcatagtaaaatgatggtgtggaagacatagattgtatttgttttgcattatccaagtgctcgagattggttctaaaaaacaagaaaataaagggcaagaagaaaaccagttacttctacattgagaggccagccaggttgccgcacacgtgttggtgcacgttaagttttgggctcacagtggtaaatcatagaaaaagcagttgcttaatttccctctttttcatattctctacgctagcactgtaaggaaaaacgcagaaagcaacatacaacgtttgttaggatgttcgtacttcacaataagcagacaataaccatttcaagtgtaaaaaaaattttttttctgttagtttgatgcagaagacttatacttttaacttttttggttaacttacacaaaccaagcgcacaacgcctgcgctttttagtattagatggcatgatttgaaaagcataaaagtctggatattggaatttagggaggcggcgggatagagcgatagtttctccccatataaagtctacaaaatgtgtgggtttttgatatcgatcgaaatttcacaaggtgttctataatgactaacatttttgtgagcagttgactctccttagtgcacattgtggaatatgtatgccatgtctcttaaaggggtaaaaagaggtattctgcatactaccagtggggtttatagcatcgtttaatcttgttatcctgtttcggtttcggcaatttctttcaaaattctgttttcaatgttatctgggaaagaaatgtttcgaaaaataatacgtaaattgttccgacaaaagagttcttgtctatgattattcaaaatgctgactttttatttagcgcttattggagtctttgctgtctgtagaaatctgaccaggcatacaaattatagttatttactaacgcaagaagtttattgtggttttcatgtgtatgtggccacgtagatttattttgtaaataagtatcgcgacagcttctattttcttggtttaatacgcctgtactaatttccatttttgagtttaggcggtgctttcgtaaaaatgatatgattattccgctcataaatggtagtcatggtaaggaagataaaaaaagcgcagttccactgtcaggcttcgtttatttaacaatatagatacatcataaaagtttttggtaatgttctctggttttacttcgtacttctgatcagaagtctgttatatcatggttcggtaccaattttttttatacaccattgtgatgatgttaaaactaaacgtataaattggtcaattatgttgctagtaatgcagctcaagcaaatttattttattggcctacataaagaaaactaactctacaacttttacggtataaatatgcaatgtgatttaaaaaatcactgaagtgtgtcagaatatgagaaactttaagtgaagcgtcatatttttgtgccctcatatcaaaaaaatgctttaaaagcagtcaaccaatgtgccaaaaattttcaaaattcaggaacttgttgttcggcagacttttattctgcctgctaaagatctgccgacctaccatagcggtcatgttaattgtaacggctatatctactgggtagactgacagttgatttccttcgaacgccaactctcgcattgccatttttagaatcatcgttaaatcttttatctcttttcggtaaaaaactagatatgactgatttggccccactacctgcggcttcgttgagcgttgcaggtgggtctatttttttgatccaatagctagctaaaaaccagcttatgacagctagtaaaagcagtacccccaaaattccataccaccacgcaatacttccatttcttcctggaacttttacattcataccgaacagaccagtaataacatttaatggaactaacattgtacctaacatagtaactttacccaacatttctgtaactttattattagagttaaatgattccacttgtaattgggccaggtagtttgcatgtgatctagaaaaaatcttttcgtacgccaataaattttgaaacatcgtcaacaaatgatcctgaatatcacctaagtataaagcaatatctccccttggttgtgatgttgtttgcatatagctatttgataagcttatttggttattactattattctggttcacattctcttgttccgcttgtaagttcaccatgttagtttgagatttaagcactggcccaataccattagtttcatcttgacatcttttggcgaacattttgataacatctgctttaccgctcaagagtctcatcagcgtcattgtcttacgcctactttcaccaatcctttgtaacatggctgcaaaatccatatcacgggtcataaacactgaatcatcaatcgaatcagcttcatactcgatggattgaataaccggagcaaaactatctgtgatatcatcgattaaagcataacataaccaatctgaattgacactgacatagtcacgtaattgtcttacacgtcttcttacattggcacagtgtgatattgggtcaaaatgaaaagtcaagacacctgacctaaaaacaacgatgtaaacatttataggttcaagataattctccgattctttatcattttcaaatgtatggaaacagacaaagtaataggatttgaaaagctctaccttttcacgcgtttcttgcatcctgatatcttccgcggtcaaaggatggattccaaatgtttttgctatgcaacgcatttcatcatcagttggacaactgcaatccaaccaccacgttggatcgcctcccttgaataactcataaaacgtctgtccctcggatatcaaagaagggatatcactagcatgcacagtttcatcagattcagagcggaagaacgaaaatctactaggaatttgatattctgtattttggagggtataatacgcccggctataactcgaatcatttccttctttttcaccttcaatcttatttctaccaaatgttacgtcagggtgtagatcaggtttatcatcttccctcacagattcattgttttcagatacgtacatctcattaacgctgcaatttttttcaagagtccgtgaaatttcaggtgtatatttcagagctgctgaggatcctgaagtggaagcagagttagtaaatccagtatcttggtcggtatgattgtatgttcgttcactgtgcctttgatggttcgccaaagacagatttctttcagcatttgaaatctgggcatattcttccaactcatcaaaatcaacaccattaactcttgtatgtaatagtcgaaacattggaaaacaaacgtcttcttctgtttcttgagaatccctggatgcttgcgatatctcactatggaaagataccctgctatccatacgtaacggtttaattcttcgtgtgtcatttcccatatcggacttttgcgatgcagttcttgtcaacaacgttgtaggattgactgatgaatgtgtcgatattgtagaataggttcttctcttaagtttcgcctgtttgggatgcgtaccatgctctgattcagccgatgtttcaaagattgcgctaactagcgaagccttacgagcgcttgtaaaagttcttgccgaggaggaggcttctaagttgcatctgttacttgacgtaccggcaggtaacgccgtatcatggcctctctctaaagccgcattctttggcaaagagggagcgatgctctctacatgaatctgcttttggtgagtttcagactttgctagcctggatggcctcgcattagaacttaaaagcgcgaaagatcttaactggtaacgtttcactgcttctgcttctgcttcaccttcaaaatccatgcggccacttgtggatatattcgttttctccacatagcctccattttccactccactattctccccgttagaggaactaaatttgtgtctagaatctttcgtttcgtccactttcaatgcaagcgcttcgtgacgtattggttgtgcatcagaatactgcctatagttctctaattttgggtacttgcctgtcttcatggaagccgccgtattgtcaacggattttgaccttggtaaatctgacgatgaatcaaatgaagtggataaggacgacattacgaagttttttcacgttttctcataaaaattcagtacttctataaaggtgattaaaatatattcctgtcgatttttttatccaactgacagtacatttccatgtaagtaattgtttagcaatagtagtctctaccgtccttgctgaacattgaatagaggaaataaacgctgttgattttacctttccacttttataatataaacctctacgttaaaatatcatatgctcgaggaaaacctgatttctctggaagcagccactttcgtgaacagccaaaccaaatgctgcatttttcgaagaaaatttttatctcaaggagtcgcttttgtaacttatagccggtcaggcagtaaaaacgtacctgaaagaatagtttgatagtaggatatggacaacggttagttttgtctgtacttcttgtatacagggcctctgtcaaatgaatgtgcgtataaattaatggaggtcttgcatagtttgttgaaacttggaagaactgtcaaccttcacatatatgatatccacggtctaagcacgaagggcacttcttgtttctcacatttaggcaactacgatgtgggaagtacagctcagttacggaatctagcacgtaggaagaataagcgataagtgttcccttcaacacatccataaaggagtttagcagctgatatatttgtcgtatctaaaaaaattttcagagtattatgacctcgtcaagtacaacggaaatatatcctgacatggaaagattagccgttcagaaagtggccctgtgcattaaatatagttgtagtttcagccgtctatatttttttttcgaaccatcacttttccctttctggacttttctcaatgtaaaaacaagaaaaacatggaatgtataatactataaataaaaaaagtaggaagaagaaccaaaacaaagggcgttttaaagagagacgaatatgcttggcgaagatgaagggaataccgttcttgaaaagggaaataatccttctgtaaaacaaggagaggttggagctgtatttatagtacccaaaatacttatcagagaacatgaaagagtgatacttaagcaaattctgcaaatcctggatcaagatgaattggttcaacctcccttagacaaatttccctacaaaaaattagaattaccgaaatatatagatgaacttaagacgagagacgctactaatacatcctacaagatgatacaattggatgcttatggtgagaaaaaagtgggttcgaacggtgaattatttggcggtagacattatttgttcaacaccttcacattcacggctcatatgggtgttcttctggtacttttacaagatgtcattaaagtgttataccaaagcaacgcaacgcatgacgaggacgagtttattgtccagcatgatcaaattctggtaatggaaacttctgaggaacaaacaaaatttttggccaaaaatggtgtcattcctgaagaatccaaaggatcttttaagtatataactgccaggtcagcctttgttgaattcggtgcttctgttattgccggtggtcaacgcatcgttgatgattattgggaatctttagctaaaaagcaaaatttgtcgtctcaccaaagggttttcaaattatcaacaaatttaatttctaaaatctcacttttacgcccctccttccaaaataacaggattagcaatgccaatgaaattagtgcgaacactaataatacctgtacgatttctacttcaaaattcgaatcacagtatccaatagtcacggaacaaccgtcagcggagattagagaagcctatattgaaaactttgccaaaggtgagcacatttcggcaattgttcctggtcaaagcattagtggaacattggaactcagtgcacaatttagagtaccgcgttatcacagcaaaaactcatttcaacaagctctgcaaatgaaggcaatggacataccaatcggaagacatgaagaattacttgcgcaatatgaaagtcaagctcctgatggttccgcttcaatttcacttcctaaccatattccatctgtcaatcctagcaataaaccaatcaaacgaatgctaagtagcattcttgatattaacgtttcctcatcaaaaaacaagaagtctgaggagaacgaaatgataaaacccatgaacaagggccaacacaaaaataatacatcgttaaacataaacggctggaaatttgaatctttgccattaaaatccgccgagaattcaggtaaacagcaatattatagaggattgccgttatatgaaaaaaacacgctgctagaaaggttgaaacagctgacaccgaacgaaattaaagaactagagcatttacacgatgccgtttttgttaataccggtttgcagaacgttagaaaagttaggacaaaaaaatggaaaaagtactggcagtacaaggcaggtattcctatcggtttgaaacggtctcaattggatgaattcaaaaataaatatttgaaagatgtgttggcgcaaacgagtgttactacaaattttaacgaaataacgaatacggatgaaacaataacaacaaagagggtaccgaacccaaacttcctaggaaattgtaacattaaggattttaaacctccatacatttattctcatgtgaacaaagtaccacaaaatgtcgctggggataaaacggctgttaagctggacactgaagtaaagaacacaaatgctaatccagtggtggcgacggatccggtcgccgctaaaccggacaacctggctaacttcagcaacgaagtagctatgaataattgaaagaagtaaaacataatgtagggaacactccaataagaaataaaccattgttgaagtagtaatataaactatcgttcgttattttataaaatatgtattgttacatatatatacatatatagggaatgcatgtgcacaattggtttgagtggaaggaataatccaaaatcatagcagtttggtctttatgatctcttgtctgattctgaatgtgtaatatgccataaccaacataatgaaaattaatggaagtaaccaaatcattagttttctggcaatttcgtcgacctgaggaccatcttgtccatgacgtttggtagcttccctatacttttcttgttcaaccaggactttctccaatttctgattgattgataagaagtctttgaaattttctttatcctcagcgattgcatcatcggtggacgttcccttttcattattagctggtggcttagaagagagctgtttagttatcgtagtcatgaatgataatagctcttgttggaccttaatgacatcatttagctttgtttctaaagcattgatatcgttcgcaagaattttaccttcaactctatccagtttcttatacaattcatagtttgtaattttgtctttgtcagcgtcaaatgctgttttttcaatcaatttttctttgccggtttgttggtcaatgtatttggtgatcagttttggctgacccattgcattcacattagggatcaaagaatcttcaatcacgccattaaaaaattgcattttgaatatttcaaaagactctgcattattattcactgctccattttgagcggtgacaccaatacggtaagacccagagggaaagcgaaccttcctagtttggaaacagactttattgtccacctgaacttttaataagttgtcgtcttccaaatcataagttactctgatcgtggaaggaacggaggaatcctgataacccatcaaacaagatgcaaaactctgatcatagattttcgtcttatctacaggcttttgaccatcatttagttgaccacgaagtgttgggcccaatggaccattgttatccactaataattgtaaaccatcatagttcactggcccattgtataactgcttatcgcgtggtacgttagaatcttgaacaaaccaaaatgatatgccaccgtcggtttggccagaataaccaacactcctaaatgtccactccatagtaaaagaatccttcaaatcgaatccttgcttcaaccaaagtgaacccttggaattttgcttagaagtcaatacaattctcccttcctctagactagcttgttctccagtttgccagttattgggcactttacgtgcattaatgagatcagggagcgagtagtctgagcttaatttggatgcatctgaagtgtcacccaatggatgagcttctagcaatccagcccatgtcgctaagacggtaaaaacactcaacagtactgtacttttcatagtaattaacatcatcataaaatacaaattccctgatgctaactatttgttaattttattggtataattataattattcaataccaattaaggcttctattaaaagatcaaaaacattcttaagagttcatactgtttctctactcgtgtatagtgataccaagacgtaatgacaataatagatggaaattgaaatattatgaaacaggaataatattccgttgaattgtaatagatgttgtacacctgcaagcgagcatgctatcattttgcgactatttttggtctgaagaccttgtctcaggtctagatgtgctttttgatagattataccatggttgtgagcaatgcgacttgttcattcaattatttgcgtcaagaatgcaatttgaagtcagtcacgggaggcagttgtttggtatagaagccggtatggacaatctgaaggcagtgcaggaagatgaagatgaaggggtgacagtttcgagggccctgaggggaattctacaggaaatgtctcaggaagggacgcatcacttgacaatagcgtcgaacatagaaagtttggtgctgcagccattcagtaaatggtgcatagaacatagggagagaattcaatactccgagaagactttgttgaccaatgtaaataatttcaggaagtctaaaaagtacgtcggtaagctggagaaggaatattttaataaatgtaggcagctagaagaatttaaaagaactcatttcaacgaagatgagctagcaaatgcaatgaaatcattgaaaatacaaaataaatacgaagaagatgtggccagggaaaaggatcacagatttttcaacaggatagcgggaatagattttgattataagacaatgaaggagacgcttcagctgttactgaccaagcttcctaaaacggactataagctacctctcattagttattctttgagcaacaccaacaatggtggagaaataacgaagtttctgcttgaccacatgtcgttaaaggatattgatcaagctgaaacgtttggccaagatttgttgaatttagggtttttgaaatattgcaacggtgttggtaatacatttgtcaactctaaaaaatttcaataccaatggaagaataccgcgtacatgtttgccaatgtgccaatgcccggttcagaggagcctaccactggtgaatccttaatatcccggttcaacaactgggatggttcatctgcaaaggaaattattcaatccaagattggtaacgaccagggggcagcgaagatccaagctccgcatatatccgataatgaaaggacgcttttcagaatgatggatgcgcttgcagcgtcagataagaagtattaccaggagtgcttcaagatggatgccttgagatgctcggttgaggagttgttgattgaccatttgtcgtttatggaaaaatgtgagtccgatagactgaatgcgatcaagaaagcgacactagatttttgttctaccttgggtaacaagatttcttcgttaagactgtgcatagataaaatgctcacgctagaaaacgatattgatcccactgcagaccttttgcaacttttagttaagtacaagacgggcagtttcaagccgcaagccattgtttataataattactacaatcctggttcatttcaaaactttggtgttgatctagaaactcgttgtagactagacaagaaagtcgttccgttgataatttcttcgatattctcatatatggacaaaatatatcctgacttacctaatgataaagtaagaacttcaatttggactgattcggtgaaattaagtttaacacatcagcttcgaaacctattgaacaaacaacagttccacaacgaaggggaaatatttgatatactttctacgtccaagttggagccaagcaccatcgccagtgttgttaaaatttatttattagaattaccagacccactaattcccaatgatgtctctgatattcttcgggtgctttaccttgactatccacctttagttgaaactgcgttgcaaaattctacatcatctcccgagaatcagcaggacgatgacaacgaagaaggctttgataccaagagaataagaggcctttatactactctgtcctctctaagcaaaccacacatagcgacactagacgctattacaactcatttttacagattaattaaaattctgaaaatgggagagaacggtaatgaagtagcagatgagtttaccgtctcaatttcacaagaatttgccaattgtattatccagtcaaagatcaccgatgataatgaaattggttttaagattttctatgatctactgacacataagaaacagatttttcacgaattgaaaaggcaaaattcaaaaaattaggactaggcgatatagatttgtatataattttatataaaaggaaatatgtacatcattttctttcactgtaggcagctgtttcaagttctttttttattggagatataattatttacattattgttatagaggacacacgaaaaagcaagaagggaactataagaaaaataaaaaataatgaagaatacagatctgtaattagtcatttcaagtgagcgtaataagtaaagtaaggtagaacggaataaaatgctcaagcgtattgttggattgcctgcaaggcgttgctttcatagaacgtcctttttgctgggcagtgactttgaaactgtgcatattcccaatacgaaccactttaaagatttacttatagagaacggtaaatttcaagaggatcaagcaactacaatagtagagataatgacagatgcaattaggggcggggttaatcatgtttcacaggatctggcaaagagagaaaaattgacccaacttagctatcaacaacgtgttgattttgcaaagttaagagatcagctattgagtgctgatagaagtgaatttcacaatattcaaaacgagtacgaaagtgtgaaaaacgatctggagaaactaagaaacaaactaagggaagaaattaccaaaacaaacgccggtttcaaacttgatctgtccttagaaaaaggcagaattagggaagaaagtagtcatcacgatctgcaaataaaagaaatcgacaccaaaattgagcaagaagtgaccaatatgaagatgcagattgattctgtcaagactcaagtcatgcaatggctgataggtgtctgtacaggtacatttgcacttgtattagcatatatgaggttattaacatagtggcgacaagcgaggaaaaagggctagacttggtacttgaaaattgcatttacgttttgtataacacagttcagtaagagtacacattcaataacgtagtaagagtatatttatttatataagaaggataaaaaagaatcaccaaacggatcacaaatggcataatcacgtagcaacctggaaataaagctataagttgaatagttcagtcaaaattttgacggtgtcatcaggggattgtactgaatgtccgatggttctttcatcgacaaaaatttcgtaatcgttaccaccgaccatagtcttgtcaccaaagaaatgaatttccttgaaaccatctttttcaacgtgttgcaaacagtaggtcttatcccaaccagcggggaaaacgtcgaaagagatttggccaccaatggagaaagtcaaaccgtagtctgggaattcctttttcaaagcttcaacgaacttggctctgatttggtgttccttatcgtatctttcgaattcgtttctttcctcagtagaagcatttctaccaattggggaaacgttgatcataccatttctaaattccaagaaagtacctcttctctttggcaagtcaatttcagatagatatctcaaaatgaagacggccaatttattgtatttttcctcaccgagccagttgatgaaggattgagaagctaattccttacctaatctgtaggcggtcaaaccattttcagagaaagaatagtcaaattcatctaaaacgtttgggcctaactgttctaattgcttgcttaagtcagaaccaccgacaaaaccaatgcagcacttgtttctcaacttggccaaagtttttctaacttcttcagaaacagttaatctggctggtgtcaaggtaccatcaacatcgaataaaaccaaagtttctggtttttccttgtaagcgaattcagcgatactcattattggtggttatattagcagataggtaaaaaaggagaaagaagtactaaggaaattgtcgatttagttttcgtcaaagatcttatactttgccaagaagaatagacgatataaacagaaaaataagtgaaaagaacacgtaaaaaacggcacattttaatatatttcaaatttttttttcatcaacgacaaaaggaatgcattttatccacttttcgtgtctcatgacgagtataccgataaacgccaaatgcgtattttattatctattttggccaaaatcaacgtgtcccgtggattcagcgtgcctagcaacttctctttcacccacaaaggtcatttggcaagtgttgcatttgatctgggccttatgagtgttgaaggaatagccagtttgcttcaaatttgaggccagttgcaaagctgctgttagaacatcatctgattccggctggttcttgttgaaaacagttttaaactcgttcatggtcaaggaatcatagtggattccgttgaacagtatcaaaatgtagttgtcgaacttgtcctcgttgaacttttcgattttaacagcgtcaatgtcgactacataaatagctactgcgagtgcatcggatatgataccaatctcgatggctccaccccaagattccattttcaaaatccattgcgcgtaatctttgttaggtttgtccaatatggcgtcattgaacttgacggggttgttgaggacctccttagagaccatctccctgaggtcacgaacgctatcttgtttgaagatgccataggcaatagcatggaacagacacgagttgtcgtcgagaacaggatgtactgataggacgttttctccactgccaccaattgacatctcagtgctcttcagcaccctctttggtttgggttgtggtggtggcaaactgaagctttcgttactatcagaggactctattgtaatcttttcaccagagttaatacccagctcgtccagctgggtttgtcccaaagaagcgtcttccccttgcaaattgatcctttgaggcggatatccaaacctcatcgtcttaacatctacattgatatgctcaataagatcatttagtgttgcatcttgcttcaaagtaacgacttggttgattcctgctccagtaactttcagtttcatcttgaaagtttcttctcttggttatcttcttcaatgttatcttgttttcaaaggaaaaagttgttatttgccactgaaatcggcttatttcgccctttactattagttactaccattgccctatagaaacgatatatattggtacgaagaaaatacagatcacaacttcagttctaccaattgcagcttcaccagttgatgtaatgagacagcaattgaacgtatgtagaacagattaaacaatagcaaaacgaccacaatcaagtataagaacaaccatgtttccatggtgaccttgagaccttgctgctctgcaattgcgggagccgtaacaaccgcttctcttggttgttcaaggtcaacctctttcaacttattttttacttctttatcatcttgctcctcttcctccttgctgatagtaatttggcactcttcgacattgttcttgatgaacttggaaagaatacgctccattaattgcgcagcctccaattgaccattcttgcatccattttcaaccatacctttgatccaactggaaccagtccattccacccaaaaggatacccgtaacagacacgttatttccgtcattccaacggattagataccttgtcttagttgagaaactaccaccactgggcacgttcggagtgcgtatgctactgataacctcatagtaagtatcaggatcttttctctttattacctcagcaacataacatgtcgtggacttgggccccgcaggaaagtgcaatgctttctcgtatgaatactcacgcttcaaagtcatggaagatccgtcaatgctcgtgaaatttggaatagtggtaatttgtgaaccttcttgaccccgtaaaaaatctagaagaaattcgttttgctctgagttgaacatgatctcaaaaagtataccaggtgcacaatcgaatggtaactccttgagaacaaactcgttattggccataggttcagccggaaagcttgttgaatgatgatatattggaccatcatactgatacgaggaatcggcacgcagtttatacgctttctctttttctttatccggcgaggaactcgtactattgggggtagtctcatttgtagagatattttcatcgtcattttcattagtgtcattatcattagcgtctttatcattgttttcctcatcgatggagtttattgcatcatcaatctctttgccatttcctgacttttctgctttagtattgatgttttcgctggccatgtccttctgcaacaaggttcttgaccacacttctttcattaatccaaatgcagcatccctggatataaaaccattaaagagagttttgcccatctttgtttcgatggatattgcgctggggaacaacccagcagcagaagttttttccataaacgtgacatcttcgaacgcaatcagtactttagcaatccaaccaagaacattggagttgaagcagagatgcgtttctgttatgtatagtttcccctggtaaagcagctctctattcagcccacaattaaaatcatccagtagtctgtcatctttaggaacggacttgaatgtctcatgaaagtctttatttctttgctcagacgcatagtgataaggtgtgtccatgtaacgttcttccacgaatcgtctatgatcgtaattgtcttctttcatttgggaaggagtgagtcttgtcttgacctcatcaggcttttccacctgttgcaagggagagcctatttcagcaattgtggcattactgatacggcggcttgatcttcttttggaccccatggaaggctcccttctatgtgatataatgcttggttgcgaaactggcgaagttggcgtagttgatctagaaactggggatggcacgtttgacttaaacgaagagatcattccactgaagaacgaggacgtcgaagaagtccttgattgatcgtgcttgatctctgtagggtgttcatcggcggcactttggtttgtaatcactactaaattcttgcgtacgtcgttggtctctgtatttaggggcacttcttgcagtgactcagcttcagtatcgccggcattgtcattgttacttgcatgctcaaaggggggacccaattgtttcacagaatcagtactgtcctcattatctgatacgggttcccagttatctacatccgacatcaccactaatctttttgtgtagttgccttcttcacccttttctcagatagcgaaatggttgagtgttttaatataattgtcaagatgctttatgaaaaagggtgggagaaacaagtccccctgctcagcgatacgcgatctctctgatctcagacataaagcaaacattctatcatgagtgacattgaggatgacggtaattggtaatatctgaccttctgacctccactcaacacaatgcagaaagctatcaaatgttttgaaccaaacatgaaagagattcagaaagttgccaagccaacgtgatgtcacaggtcaaagtttaagtgaaggctattggaatctgcggatcagacattcactactacacggatggccaggtcagcgtaaagtaacctgggaagcccatgactttgggccacgaatccaacggtgctgttcttgaaattgaagtatctcaaactactgtaaagcgggtgatgcagtaagcatatagccctcatacccaaataggtttaccaaagagtttctgtgaggccattatagtttgcagctcaacataccatttgctgcatcactgaccgtgacggcaccctttgtcaagagttcgtggttaacgtcgactgcgtttactgattaccgttacagtgaatttctagcaagagtcctctgtagatgccactatttgtcgctctccatgtagtaaggccgtcctagctgaagtgtggggagtaagctgtagttataggtgctggaacaattgatctgctggcgggtgcggtactcagagggtttggtgttcatgagtacacatgattccaagaaagagcaaaatggacagtttataaacgctatgaagaactgctataatcagaaaaaaaggaagcctgatggattcgagtcctcaggtactcaaaagagcgttgagaatatgctaaaatgtgtcaagaacggtggaacagttaagtaggttgatatccacccctcgaatgaaaatgtggggaccctcccaacgagattccttcagagagattacatataaagtgaaattcaagtatgacgatggtgactactccttggccattgatttgatgtctagggattgtattaatgtctatgagttgattaccgataggctactggttgatttcctttcaaaaaagctgctcaagctaagataggtaaggtgtttatagaatttatcgaactgtatctaaatatttttaatattcttgttttattactttgtggcttttgtattcagtctgcaccctgtttcgccatcgattcttataatacatacatttttatataagatcacagaaaatacgaagacgtaaaaaaagagttccgaatgaaagaagaaagaatcaagcacaggaagacaagaaacgatgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatggtccttctatggtgacacaatgtcccatcgttccgggacaaacatacctgtacaacttcactgtcccagagcaggtaggaacgttctggtaccatgcacacatgggtgcccagtacggtgacggtatgaggggtgcatttatcatccacgatccggaggagcccttcgaatatgatcatgaacgagtcatcactctatcggaccattatcacgaaaattataaaacggttaccaaagagtttctgtcaagatataatccaaccggtgctgaacctattcctcaaaatattctttttaataatacgatgaatgtaactttagattttacacccggtgaaacgtatctcttcaggttcttgaacgttgggctgtttgtatcccagtatatcattcttgaggatcatgaaatgagtatagtagaggtggacggtgtttacgtaaagccaaactttactgattcgatatatctttctgcggggcaaagaatgagtgtgttgattaaagctaaagataaaatgcctacaagaaactacgctatgatgcaaataatggatgagacgatgcttgatgttgtcccacctgagttacaactcaaccaaactatccaaatgaggtatggccactcgttgccggaggcacgcgcattgaacattgaagattgtgacttggaccgcgccacgaatgacttttacctagaacctctgattgagagagacctacttgctcactatgaccaccaaattgtcatggatgtaagaatggtcaacttgggtgatggtgtgaagtatgcatttttcaataatatcacttacgtcacaccaaaggtgcctactttgacaacgttgcttacctcaggaaagcttgcgtcagatcctagaatttatggtgataatatcaatgcgcagttattgaaacataatgatatcatagaggttgttctaaacaattatgattctggcagacatccattccatttgcacggtcataatttccaaatagtccaaaagtcgccagggttccatgttgatgaagcttatgacgaatctgagcaagatgaaatgaccgtcccttataacgaatctgcgccattacaaccgttccctgagaggccgatggtgagagatacagtggttcttgaacctagtggacatgttgtcctgagatttagagctgacaaccctggtgtctggtatttccattgtcatgtagattggcacttacaacaaggtttggcttcggtctttattgaggcacccgttttacttcaggaaagggaaaagcttaatgagaactatctggatatatgcaaagccgctgatattccggtagttggtaatgctgcaggtcattcgaatgattggtttgacttaaaaggattaccaagacaacctgagccactaccaaagggatttactactgaaggatatttggcattgattatttcaaccattatcggtgtctggggcctatattccattgctcagtatggtattggcgaggttatccctaacgatgagaaggtgtaccacacgttaagggaaatcttggctgaaaatgaaatagaggtttctcgcggctaattaaacaagaaaatataaaagaaaaatgaaagaagtttatattcatattgatgatttgcaatcctaaaaaaaatgtagcactgtaaatactgcttactattgagtattttcattttgttcattccattccctatataatattcatacgtaatcaaatctattgctttttttttctcttttatttcgttgttttagctctgacgttgtgacgctcagccaagaacgtcacaaaaaaaggatgaaaatcaaaaaacaaaatattcaataagtgtaatatgagaagagaaaaaagaaagaacaagtacagtttctaacattatactttaaaaattattaagcacaatgacagcaatgaaagctattgtctggagacttcccaagatgccgaaaatcaaaattacaaaaacttatgaagttacgaaaattacggcgatattgacactagtaggatttataatgggccttgaggtgccgtcattggcaacttttctcacaaacaaaacgtttaatgagtacttcaagtatccaactcctttacaacaaggtttactcatggggtccacccccctgggtggtatcatgggatgttttatttgctgcataatgaatgatagattcagtagaatatatcaatttcaatcgggaataataatatggaatattgttacgttattgaacttttgtatttgggatatattaggtttactaatttgccggatgatcaagggtatgatccttgggaacttttcaattttagtagcatcctacgcaaatgaagttatcccccgcggcaagcgtggaagtacgatgagctatattcaattgtgtttaaccattggaattcttgttatgcattatttgtgcattgcattaagtctatgggattctcattttgcgttccgtatagcgtggtgcataggaatcattcctggattactgttctggatggctagctacgctctacctgaatcttatcactggctagtactacatgggaagatgagtgaagctcaggaaattcagcacaatttagccaaaaagtttaatgaaagccagccaagggatgcagtccctgagatgagtaagatcgaattagcaggagatttttggattggagttaatgatttggacttctccaaaaaattacctcggggttcgtttaagcctttgattcttggaatgactttacagttattggttcaatttagcggtataaacattatccttggttatattacatacatttgcgagattgtagggcttgaaggcaatgtaaaactattcaccagttccattccatatttcatcaacatggttttgagcttgttaccgattacattcattgattacactagcagaaagctaattaccttgttgggtggctttcccattagtgggttgctcattacaatcggcgcattatttgtgaagtatggtcaagacaccaagcccatcgacggcaataggagtttagtttggtcaattggagaaaacccgtttgtgggaggatggattctaactttatgctttctaattgttggaatatttgccatgagcctttccagtataccttgggtttacacgaatgaaatgttgccctcacgagtgaaagttaagggatttgccatttgcgtaacgtttggatggttgggcaattttattttaacgtttctatgccctgtgatgattgaaagattaaaaggcacaacatttataatatttggatctttgacattcttgatatcactttcagttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatgatacacggtccaatggataaacattttttatcaacactatgatatataaatataatagtttttcgtatatatattcctttttttggtcaatttttgaaattttcgtagaaaagggagagacaaaacacattatatcaatgaaaacgtacaaaaagtagataaagtcagtgcttaaacacgtcttttccttaaaaatactttattatttttattttattgagagggtggtttaaaaatagaaatagagagagaggtacatacataaacatacgcgcacaaaagcagagattagaaacacttgtggtgaacgatagatggaccactttcgtcgtattcttgttttgagatccacatttgttggaaggtagtcaaagaagccaagatagaaccaccaatccagacggagtactttctttctggaggagcaatgatcttgaccttcatggaagatggagccaaagcggtgatttccttttgcattctttcggcaatacctgggaacatggtggtaccaccggacataacgatgttaccgtataattccttacggacatcgacatcacacttcatgatggagttgtaagtagtttggtcaataccggcagattccaaacccaaaacagaaggatggaacaaagcttctggggctctgaatctttcgttaccaatagtgatgacttgaccatctggaagttcgtaggatttttcaattgaagaagattgagcagcggtttgcatttcttgttcgaagtccaaggcgacgtaacatagtttttccttgatgtcacggacaatttctctttcagcagtggtggagaaagagtaaccacgttcactcaagatcttcatcaagtagtcagtcaaatctctaccggccaaatcgattctcaaaatggcgtgaggtagagagaaaccagcgtaaattggaacgacgtgagtaacaccatcaccggaatccaaaacaataccagtagttctaccggaagagtacaaggacaaaacggcttggatggaaacgtagaaggctggaacgttgaaagtttcaaacataatttgagtcatcttttctctgtttgatttagggttcattggagcttcagtcaaaagaacagggtgttcttctggggcaactctcaattcgttgtagaaggtatgatgccagatcttttccatatcgtcccagttggtgacaataccgtgttcaattgggtaacgtaaagtcaagatacctctcttggattgagcttcatcaccaacgtaggagtctttttgacccataccgaccatgataccttggtgtcttggtctaccgacgatagatgggaagacagcacgaggagcgtcgtcaccggcaaaaccggctttacacataccagaaccgttatcaataaccaaagcagcaacctctaaacatataatatagcaacaaaaagaatgaagcaatcgatgttagtacatgagacttagtaacagtagcaaataaaagaagaatatcactatcacttatcacgaaaatatttcagtttttttttttttccaaatttcaagcccctatttattccaataatatcgtggttattacagatcagtcaatataggaggttatgggagagtgaaaaatagtaaaaaaaggtaaaagagaaatctctcgagcaattgggaccgtgcaattcttcttacagttaaatgggatggtgcaagcgctagaacataccagaatccattgttaattcagtaaattttcgatcttgggaagaaaaaagcagtaagcgtgaaaaatctaaaagctgatgtagtagaagatcctattctttaacaaagattgaccttttctttttcttcttggtttgagtagaaaggggaaggaagaatacaagagagaggaaaaaaaggaagataaaaagagagcgtgatataaatgaatatatattaaacaagagagattgggaaggaaaggatcaaacaaacccaaaaatatttcaaaaaggagagagagaggcgagtttggtttcaaaacggtttatttatttatgcaagaggacgtggaagaaaaagaagaaggaagaaaaaaatttgaaagaaaaaaacgcgtggcgggtaaagaagaaaatggaaaatagaggccgggtgacagagaaatattgagggttaattggaaaatatgttagggtgaggcatatgtttttaagggttttgaggatccgataaggaagaatgtaggttaaatgttgtgcattaattgctgtggcagcttacccgcttccccacacattttggtagtatctgtcctcttgttattgttactgtaattgtgtatatatgttctcgcgtgtgtcttatttacttatttagttattatattatatgggtctgcaaggtagaggcgcgcttgttcaacagcagcccccaccggtgttggttaaactctgtcccttcaggttgacgttccctttgtcttccttcttctgagtggtttcgttcaggttttgttgggacatactttccttgatttgtctagccatggttaaaaacgcatcctcgacgttggtggagtccaaagcactagtctctaagaacggcatcttattcgcgtccgcaaattcctttgccacgtcatattccacgacacgcttgtcctttaaatcacacttgttacctaccaatagcttcaacactgttgaggttgcataccgatcaatctcttgcagccacatcttcacgccgttgaaggattcttggtcagtgacatcatacacgataatgatcccatgcgaaccacggtagtaagatgaagtgatagtacggaaacgttcttgacctgcagtgtcccaaatctgtagctttacagtcttgccgtccagttctacagtcttaatcttgaagtccactccaattgtggagatgtagtcgttggtatatgtgtcgtccgaaaacctcaaaagtaaacaggacttcccgacaccggaattcccgatcaacagcagtttgaacaggtaatcgtactcgctattcatattagtgcttttcttgttttatttatttcaacctgggcctaacagtaaagatatcctcctcaaaactggtgcacttaatcgctgaatttgttctggcttctcttctttttctttattccccccatgggccaaaaaaaatagtactatcaggaatttggcgccgggtcacgatatacgtgtacagtgacctaggcgacgccacaaggaaaaaggaaaaaaacagaaaaaacaacaaaaactaaaacaaacacgaaaactttaatagatctaagtgaagtagtggtgaggcaattggagtgacatagcagctactacaactacaaaagcaaaatctccacaaagtaatataatgagagaaatcattcatatctcgacaggtcagtgtggtaaccaaattggtgctgcattctgggaaactatctgtggtgagcacggtttggatttcaatgggacatatcacggccatgacgatatccagaaggagagactgaacgtgtacttcaacgaggcatcttctgggaagtgggttccaagatctattaacgtcgatctagaacctgggacgattgacgcagtacgcaattctgccatcgggaatttgtttagacctgacaattatatctttgggcaaagttctgcgggcaacgtgtgggccaagggtcactacacagaaggtgctgagcttgtagacagcgtcatggatgttattagacgagaggccgaaggatgcgactcccttcaaggtttccagatcacacattctcttggtggtggtaccggttccggtatgggtacgcttttgatctcgaagattagggaagagtttcctgatcgtatgatggccaccttctccgtcttgccctctccgaagacttctgacaccgttgtcgaaccatacaatgccacgttgtctgtgcaccaattggtagaacactctgatgaaacattctgtatcgataacgaagcactttatgacatctgtcaaaggaccttaaagttgaatcaaccttcttatggagatttgaacaacttggtctcgagcgtcatgtctggtgtgacaacttcattgcgttatcccggccaattgaactctgatttgagaaagttggctgttaatcttgtcccattcccacgtttacatttcttcatggtcggctacgctccattgacggcaattggctctcaatcatttagatctttgactgtccctgaattaacacagcaaatgtttgatgccaagaacatgatggctgctgccgatccaagaaacggtagataccttaccgttgcagccttctttagaggtaaagtttccgttaaggaggtggaagatgaaatgcataaagtgcaatctaaaaactcagactatttcgtggaatggatccccaacaatgtgcaaactgctgtgtgttctgtcgctcctcaaggtttggacatggctgctactttcattgctaactccacatctattcaagagctattcaagagagttggtgaccaattttccgctatgttcaaaagaaaagctttcttgcactggtatactagtgaaggtatggacgaattggaattctctgaggctgaatctaatatgaatgatctggttagcgaataccaacaataccaagaggctactgtagaagatgatgaagaagtcgacgaaaatggcgattttggtgctccacaaaaccaagatgaaccaatcactgagaattttgaataattaagttgctttcctttctttttcttacctttcttcttctctaggattgaagcacttggagcaaaataaacaaaaatcaaaaaaactaattaaatatctttaaaatattaccgtacgaaaaaatttataccattccctactgaagtatgtaattcaaaatatatatatgtatatgtatatgtacatatatatgtatatactatcttaacaacctttaaccttccgagctattgatttttgatcctcacttcagcggctaaaaaaaaaaaaaacaccccgagtattagtgaatatagatatatatatatatatatatatatataggggggccgataaaaaagaacttgcaatattacgcagatcagggatttactaaaagaaaagtaataaaggactgctgcttccaaagaaagaagattacaacatgttgatgattgtggaagcggtgcttatggtattctacctgtttccccagaattttgttgagaactaatcatgaacaaaaaactgtgttttatattgtgatttccataattccattacaattttgtaccaagcataggtctgattatcaacaatacgctgcttcagtccttttatttagcagtacgttgcttgttattccttcatcatctagccgccatagttggaaccccgcgtgaaaaatgatatacatttcgtattcagtgatctggggttgcatgaataaaaattctgggtaaattgtgggtgggtacactttggcaaaggctaaccccgaatttttcattatttcggttttttttctttttaatttcaagaaaatggaaaactttaagaataacgacgttgattttagcctctccgtgaagatattggtaaaaagataggtgtcgtcgattatagccaccagcttttacaaaagataccaccagcttgtgaatagtttttaagaaagtcgctttaaaaggactacctaccccagatcagaaacaaaagcagatctcctgttcatataccatttgtattctgcttctttacattttatacattccttggatcagttcctccccctctttgatattcactcaatatgctgagaccggcctataaatcgctcgtgaaaacatccctgttacaaagacggttaatatcttcaaagggatctaagctgtttaaaccatctccggactcaacaagtacaatattaatatctgaagacccccttgtaacaggctcgtccccaacctcatctacaacatcaggtataataagttcaaatgatttccctttgttcaacaaaaataggaaagacgccaagagcagcatatcctaccaatggaaaaatccttcagaattagagtttgaccctttcaataaatcgcatgcctcagcagtaacctcgatgacaagaactagagacgttatgcaattatggtctctgttagaagcatgcttgcaatcgaatctaatgaaaagagcgttctctatattggagtcactgtacctggtacctgaacataagcagcgatttatcgaggattataacatgtacttgaattcattttccaaaaatgaccctaatttccctattttaaaaatgaacgaaaaattaacaaatgatttggagacaagttttaaagacgttaattataatgacaaaactttggcaataatgattcatcacgctttgaacttccattcaacgacaagctcgatgcttttgaagcctataatctctgcctacttgaaaatgagcgtgaatggtattagggaaattttctcctgcctagatattttgaccatttcagatctgaatattttaatgaatgacttaaaggttataacaccatcgcaactgccaaattctgtaagaccaatattagaatcacttacgctatctcctacacctgtaaataatattgaaaatgaggagggtttgaacaaagtggaagctgagaacgattcaaaattgcataaagcatcaaatgcaagctctgattctataaaaaaaccttccttggatcctcttcgggaagtttcattccacggttcaacagaagtcttgtcaaaagacgctgaaaagcttatagctgtagacactattggaatgagagtaatccggcatactttgctgggattatcattaacgccggaacagaaagagcaaatttctaaattcaaatttgatgccaatgataatgttttgaaaatgaaacctacgaaaaacgacgataataataattctataaatttttttgaaatttacaattcactgccaacattagaggaaaagaaggcattcgaaagcgcattaaatatatttaaccaagatagacaaaaggtacttgaaaaccgtgcaacggaagccgcaagagagcgttggaagcacgattttgaagaggcaaaagctagaggtgacatttcaattgaaaagaatttaaacgttaagttgtggaaatggtataatgaaatgttacctctagtgaaggaagaaattaatcattgtaggtcattattgtcagaaaagctatcagataagaaaggcttgaataaagttgacacgaaccgtcttggatatggaccatacttaaccttgattgaccctggtaaaatgtgtgtcatcaccattttggaactattaaagttaaattctacgggtggtgttattgaaggtatgaggaccgcaagagcggttatatcagtgggtaaagctattgaaatggaatttagatccgagcaggttttgaaaagcgaatctcaagcgttcagagatgttaacaagaaatcaccagaattcaaaaaactggtacaaaatgctaaatctgtattcagatcatctcaaattgagcagtcgaaaattttgtggcctcagagtattagggccagaatcggttcggtattaatctcaatgttgattcaagtcgctaaggtatctgtgcaaggtgttgaccctgtgacaaaagctaaggttcacggtgaagctccagcttttgcgcatggttatcagtaccacaatggttccaaattgggtgtcttgaagattcacaagactttgattcgtcaattgaacggtgaaagattgattgcctctgtccaaccacaattattaccaatgttggtggaacccaaaccctgggttaattggagatcaggtggatatcattatacacaatctacccttttaagaacaaaagactcacccgaacaagtagcatatttgaaagctgcttccgataatggtgatatagaccgcgtttatgatggtttgaatgttctgggtagaacaccgtggactgtcaacagaaaagtttttgatgtggtttcacaagtttggaataaaggtgaaggtttcctagatattccaggtgcacaagacgaaatggttttaccaccagctcctccgaagaactccgacccttccattttgagagcctggaaacttcaagtcaaaacaattgctaataaattctcttcagatagatcaaatagatgtgatacgaactacaaattggaaattgcaagagcatttttgggtgaaaagctgtactttccacataatttggactttaggggacgtgcttatcctttgtctccacatttcaatcatcttggtaatgatatgagtcgtggccttttgattttttggcacggtaaaaaattaggaccttctggtctcaagtggttaaagattcatttgtcaaatctgttcggatttgataagttacccctaaaggatcgtgttgcatttactgagtctcatttgcaggacatcaaggattctgcggaaaatcccttaacgggagatcgttggtggactactgctgataagccatggcaagcattggccacatgctttgaattgaatgaagttatgaaaatggataatccagaggagtttatctctcatcaaccggttcaccaagacggtacttgcaatggtttgcaacattatgctgccttgggtggtgacgttgaaggggctactcaagtgaatctggttccaagcgataaaccacaagatgtttatgctcatgttgcaaggttggtgcaaaaaagattagaaattgcagcagaaaaaggagacgaaaacgccaaaattttgaaggataagattaccagaaaggttgtcaagcaaaccgtcatgacaaacgtttatggtgttacctacgtcggggctacttttcaaattgctaaacaattaagcccaatatttgatgatcgtaaagaaagcttagacttttctaaatacctaaccaaacatgtttttagtgctatccgcgagttatttcatagtgcgcatttaattcaggattggttaggtgaaagtgcgaaaagaatttccaaatctatcaggttggatgttgatgaaaaatcgttcaagaacggtaataaacccgactttatgtcatccgtcatatggacgacaccactaggactaccaattgttcagccatatcgtgaagaaagcaaaaagcaagttgagaccaatttgcaaactgtctttattagcgatcctttcgctgtcaaccctgttaatgcaagaaggcaaaaggcaggtcttccaccgaacttcatccattcgctggatgcttcacatatgttgctaagtgcagcagaatgtggaaagcaaggattagatttcgcatcagttcatgattcttactggacgcatgcatctgatatagacactatgaatgtggtgttaagggaacagtttatcaaactccatgaggtagatctggttttaagattgaaggaggagtttgaccaaaggtataagaattacgtcaagattggaaagttgaagagatctacggatttggctcaaaagattattagaatccgtaaagatttatccagaaaattaggaagaagtactacattagcagatgaaatttattttgagaaaaaaaggcaagaattattaaacagccctctaatagaagatagaaatgttggtgaaaagatggttacaactgtatcattatttgaagacatcactgacttggacgcacttgaactagaaaacggtggagatgaaaatagcggtatgagtgttcttttaccgttgagattacctgaaatcccacctaaaggtgattttgatgttacagtattgagaaacagtcaatattttttctcgtgagccgtgaactacaaactaaaatttatttgtgttatttttatttaacttgtacatatatatatatatacatacttagcgtttatcgtttgcattatttttcattctttttaattgtttatattaagtgtctaaaataggagtgacccatggtaactaataataataattgtgttcacctctaattataaataattttgccctgtttttcaaagctttcaattaacggtagcagcggagccatttcctttctgtcaatgatcttaaactcctttgcaaaactaatgaaatgagagaaaaatgaattccaatgagcttctaatgacaagtgcacaattttgtcaaagtggtggtgataaatatgtgcgaatatcctgaacatctgtaccatgattctctgcacatctctcgaaaattgctgcgggaatggtagcccatttttggtcggaaacaagtttttatcgttcactttgttatttatccacgtgagggccaaatctatgtactgactagctggcagtgaaacctgtctattgtttgcgtccagccataaataatccgtgtgagggccagcgttcattgttggatacgcgtcaggcgttacgtactccgctactactccgtaaaattggttcaagtttgtgaagaattcgaaaacgttcaacgctatccactctcccaggtccacatatttgggcaattgtactattgttttaaatgaacctttcactaaagcagttcttacgaacggttcgctgagaaacattatctgttgtgattctgatctctcactagcttcttgctgttgagactgtggtgtggtagatgtcaattgctgtgattgcggcgtagacttttgtgcggggaaacttgtttgagaatgcctcttaggcgaatgatgtttatttcttaacgataatctggaattgctgctgtgggggcttgaataaatggtgttcattgctggcggctgagcaacattaaggggctggtttttatttttctttgagtttcttccgaatgctctgttttgcaaagtatacacgtaggatcaaatgatttgattaggtgtgttggctagttagtaaaatgataacgcaggtccagaagaaaataaaacgacaacagtgtgaacatacttgaagttgaagaaggacatgatgtgctgataaatgcttggttggcttgcggaattggggtagttgcttttcttaaagttttttgatgatcttcgtgtttcaaaagctaaagcatttctttttcttttctatttttcactaattttcgtgaagtgacatattgcaaaaataaaatatgtaaatcaaaagagggacaaaaggatatattaagggtggtgaattatgatatgaatagcattttataaattaatatacatgtgagtgtctatttattcgtcatcctcttcttcgtcagcatcttcaggggtgacttgatagaaaaccaatttgtattggttttgccttatagagacgaatctgatccagtctcttagctgattcttcttcaaatacttctttgttagatatttcaagtatttaccagaaaatttggcactggatactacagtgactatagaaccatcttcagtaacctcaatggcgttccctaagtttcctacggcaccatctactttaatatgatcgattaagtacttggaatatgaagccggatcgaagactccgttttcagttggagaggaaacgtcaacggttaaggttttgataactttttgctttctggaagtctgttacagttttatgttagtaatcccaactgagatgaaatcatccttgtcgtttggacgaggaaaaaatgtctggcctactgctattaacaatcacttcatatagctagagaaagcgcattgcctctgttaaagctataaggggtgaatttttaaaatacagaatagctgaatacataaaaatgtaacttcgagatggaatccactagttcgctgtgaaagcgggactgttcaatgaactgtaggaatagacaaactttttaaagattttattttctttcatgttctctaattgtgacataggaacgaaaattaacgtacgtttggagccattgtggttgatatttgtgaaacgatataggtttactgtgctacggtgtttttatgatcccagatgttcaaaaaaaatcaataattatcaattaatcgtgtactttaataatccatatatgaatcatttaggtaattagctcttttttgcttgaaaaattcatccattcggctcgcgttgtctaaaaaaaaagtttggaaacttttttgtataatttatgggtgttatctctgaatatgtacgggtgttgacatggagaaagcagtctcgatattttgccgaccttaatgctttaagaatatgaaaggaaatgcggtgcaaataaacgatcctatcgtggtagtaggaaagggtgtgtactactaatagagaattataccatacgctagtttgtttccgagtttgaatagcttcgtattttccttactggctggtacagttagttttagtgattctattagtgattggaaagcatagtggaagggtttctcgaacgtaatagaggcagagttaaaagagaagattaaacattacagtactaaaagatgtccgattcggaggaagatttaggtgtacagttgaaaggcttgaagatagcgaggcatttgaaggagtcaggggagcatactgatgaagaatccaactcaagccccgaacatgattgcggcttgagtaatcaagatgatttaactgttatgcatacacaggctaaagaagaagtttttaaacgaagagaagaagacggaacacgaaccgaagatgctttacatgagggagaagcaggaaaagagggcacaggttttccctcatcacagtcagtgtgcagtcctaatgaagcagatagcggtattgatcgggccgataaacctattttgctggacccttttaaatctgtgcacgatacggatcctgttccaggtacaaagtccaggagcaattcagactccgactctgattcagatgatggaggctggcaagagatgcccgctgtctcatcgttcaatatatataaccacagaggcgaactagagttgacttccaaggttagaaactcagaacaagcctctgagacgtctcccacagttcctccaggaaaaaattgcaaaagtgtcaatgattctagatttgactatacgaaaatggccgctgagcagcaagcccaacgatcctatcgaacaaataaaaaaacagatttcctttttgaccacaaagtactgaaaaagaaaattaacagttcgcaaacttccgtaaatttgacttcttccccttcgactacatccttgaacaatgaaaaaaataatgatgacgatgatgatgattcttatgacgaatatgaggacgacgtggaaccagtgaacgacttgaatcgggactcgcagttaaacataacgaaaaatctgctatctgatatggagaagtttgcctacgtaggtgcaataaacattttggcaaatcaaatgtgcacgaatttggctacgctgtgtctttgtattgacattaaatcccacaagaacctagcacatagattacagtttacccagaaggatatggctgcttggaaaactgtggttttatcacggctatatgatcatttggggatatctcaagaagaaattgttatgattgagaagctttctctgcacaaaatccaattggaagatttgtgtaaatgtttgaaaaccactcagagcattgataatccatgggagaatgatagagaccacgaagaagacggtatagaggaaactacggaacgaatgagtccaaatgaacaaaatggctcagtacaggctagtactcccgacccagaacaatccgcaacacctgaaacaccaaaggctaaacaatcaccgttatcttcggacgttccaggaaaagtactcgatccggaaaatgtcaaaagccaagacaaattaaatatagatgtggcgtggaccattatatgtgatcttttcctaatatgcttgcaatcctccacctatgattcgaggtcaaggactttgttgataaattttgccaaagtcttgaatatgactagcttggaaatttgtgaatttgaaagacgagtaacagattccttagacatggaacaatctacagaagatcaagtatgggatgaacaagatcacatgagaaatagacggagaagcaaaagaagaaagaaaatggcatatgtcgcacttgccatggtaggtggttctttggtccttggactaagtggtggtttactagcccccgtcattggcggggggattgctgctggtttgtcaacaataggtattactggtgctacaagtttcttgaccggagtgggtggtaccactgttgttgccgtttcaagtactgctattggtgccaacatcggtgctagaggtatgtcaaaaaggatgggaagtgtgagaacttttgagttcaggccactgcataataatagaagggttaatctaatcctaacagtgtcaggctggatggttggtaacgaagatgatgttagattgccattttctacggtggaccctgttgaaggtgacctgtactcgttatattgggagcccgaaatgctaaagtctattggtcaaacggtcagtattgtagctaccgaaatttttaccacctcgcttcaacaaattttgggtgccactgttttaacagccttgatcagttctatccaatggccgatggctttatcgaaattgggttatattttagataatccgtggaatgtttctttggacagagcttggtctgcaggcaaaattcttgctgacaccctaattgcaagaaatttaggtgcccgccccattacactggttggcttctcaataggtgcgagggtcattttttcttgtttaatcgaattgtgcaagaaaaaggctctaggtttgattgaaaacgtttatctattcggtacaccagctgtcatgaaaaaggagcaactagtcatggcaagatctgtagttagtgggaggtttgtaaatggttattcggataaagattggtttttagcatatttatttagagctgctgctggtggatttagtgctgttatgggtatttctacgatagaaaacgttgaaggtatcgagaatattaattgcactgaatttgttgatggtcatttgaattatcgtaaaagcatgcctaagttattaaaaagaattggtattgctgttttaagtgaggagtttgtcgagatagaggagatgatgaacccagaagaagtgaaaagaaaaaggaaattaataaatgatgtcgatgcagcccaaaaaaaactaagtgaaagaaaaaagcataacagttgggtgccgaagtggttgaaaccgaagaaatccaaatggaaggtcatggtcgaagaagctgtcgaagaaggaagagatatgcaagacctaccagaaaatgacgtcaataacaatgaaaacgaaaatccagatgaacatgaagggatagcaaggcaaaaacgcagagatgctgctcttgtcgatcatggggcattaatgcatgagttacaacttataaaacaagcgatgcacgaagacgaaataaagaataaagcatgccttccaggagaagacaaggaagtggaatcatcaaacgacttcttgggggagtcgcattacaaaccaccgtcaacaccaaaaattaatccaccacaaagccctaataacttccaattgttaagtgctgggagaactattcttccagaggatgatgatttcgaccctcgaggaaaaaaaaaggttgaattctctttcccagatgatatctagatggcttttattctattaaaatgatctatcatagacacattcataggttaaataggacgttctccaaaatatgtaacaatactatatagaataatatatgtgttttattctgcttttaatatttccagattttaaagttttgatacaaaatatgaaattagggacttcaaaaattctaatttagcctcgaaattgagaaatgaaattagatcataaattaactctaacaaaggagaatatatatacgtacatatatatatatatatatataagttattgtaattgagaaaaaaataaacatcatataaaacttccgttttaatgaacgggggaaaatccatgattattctcagatttgctttcaagcaaagtttttattcagttattttttttaattatctttatcttaaaatttatcagtgcgtttcatcagaatcgctcaatatagtatgctcttcatcttcttgagactttttcagtgcgtacttagccaccaatttttttagctcgtcaagttttaccggtttttctaaaacatcgtcaaagactctactggttgccgcctcctgaaaataatttgttatggccacaattggtgttgtcgaattagcaccatttgtttgctttagtagttgaacaatgtcaatagcaccaagttttggaagcttcaaggctgtcataattaagtcaaaacttacaccactagtggctctactaactagttcatcaccggcaccaacactgacgacggtacagcccaaattttctaagtctttagtaacccgatatctatgaatcggtataggctcacaaacaagaacatccatgtggtatccaatctcagaagtgctcgagctctttcggccactacgcctcctgtttcttaaagagttaactcttgatatagcctgtagtcggtcgctttcctctgccgagagatcactggaattggtccgttgcgaaaaactctttgatagaaccctctgtcttgaaaaatatgagctcacggtggtggtattagcaggtgatagtggcgacttgaatttagtcatcgtaggtgaatccgagctatttgctgttgtttgttggttatccccgattatactacccttccttgataatgttgacgagtcgatactaatacttcgttcaggagaatatgatcttgtggagaatgaatcagacctcaaaaatgttttgggaaatgtgccaaatgttgaaggagaaccggatatggtaggcttatgtattttcaacttgccaccagatgtagtgtttgaagcgttactccctggagttgacactgatccgtctgaggatgaccccattagtgacgcagaagaggttcttctgtgaaccccaggttgttcagaaaaatgttcacttttcagtctatttatagcatctttattagctttatcaagagccgataaattcctgaaattaaaagaaccaaattccgtttgtgaatcattcaatttacttgatctgcgatccctcatatgtggaggtatagccagtgacaaattcttcagattgggtgagtttttggcacttgtagtagttgtaccggtcccgttaggtgtaatatatcctgtttcttgaggtactgactctaatacagaagcaatacttaatttattaaccggtgtatgtgcaccaaagtcatgcacgctactgttggaattatttgagctcctattagtggtgttactcatcgatagtttacgggataaaatatttttatgattcaatggtggagagagattagctgcagataattcagaaacatcggtgttaatgccatgtttaccaaacaaaatattggcattatcgttttcgatatcgtctccaaaatcttggagctctgcaccccttaggtcaaaataatcagtatcttctggattgtctattgtagggacaaaagaagcttcctcatcgtaaacatgatcccaatccacattcttgaaataagggtgatctttaatttcttgaattcctttcgcacccagtcttttcgcaggatccacaaccaacaatttttctatcaaatcttttgcctctggtgttaggaattctcgctcttcttcttcatttttaaactctggccattgaatgactcctgatagaattttcttaaaaacagcatctggtgtttctgcatggaatggaggataccctaaaagtaattcgaaaaatatacaaccaactgaccaccagtcgcattgcttgttatcttcaccctttccttcaatagtttctggagcgagataatcgggagtcccaaaaaatttcttattttgcttgctatcatcaggataaaacaaagctaaatccgaaggtgctggcgaaagggaaatgttattattcgagttaatattcgtattggtagctgcgatagcatctgaagataataggtcattagaaaaggatttattctcagtgagtgatttccttctcataatattattagcgttcgaatttgtgggatttgctaaaggaggagtactagaacgagaaatatcaaggagggaaaatgataattgagattcacttcttctaagggacgctgggagatcgatgttcgaacttccgtgtgatctgtccttcccacggtaatatgaaggataaacaacagtgttcgtactgggcgttggcgtcattgagtgggaattggaagtacttgagtattctgagtgttcgtattgctgacctagtgatgacttcttgcttctattatactgcttatgatctgatgtgaagctatctggggttgataattgagaatgattactattgttgttgttcatggtaaaattatttgctgggttatcgattggtaaagtggaactgatacttagcgacgacttatgtgggacaaacttgtgacggcgaatcagaccagctcttgataaaccgaaatctgttaatttcacatgacctgcattatcaattagtagattttcaggctttaagtcatgatgaatgatcccattttgatgcatatcattcacaccgacaacgatttcggttaggtattgcttggcccattgatcgggcagataccccatcatcttgattaaagtggccaaatctccacctggtaaatattccatcactaagaaaaggttatctttattttggaaactagcaaatagtctcgcaacatagggcttatcactttgaaccatcatgattgctctctcggatttgacatttgttacttgatttttggcaatcatatctgatttccttagaacctttatagcaaaataatctcctgtgagttttttccgtgctagataaacactaccataagcacctttgctgattggtttcaagatatcgtaatcttttatgctaggcgttggagatttaacagtttggtttgtggccaataaaaggggtgataatggcatattcggtgaagttaacattgcattattgatactatctgttctggcaatattggaagggtgctgctctggggttaaaaaatccttggagaatgtgaaaggtgaagatatcggcgatttatcatgaatcagtttaaaactgtttgtctgctgcatagaatggcttgcgagattaccaaatgatggtgaaccacgccttggggtcaaggaaatacttgtcattagttttggtaatactgagtttgtggaattgttactattagtcttggtacccgtggtggtcgcctgagtagaggatgttatggtggtatctacggaaggttgaggttgaagagaatctttatctctagacagcatttcgttggtgcggtcatcattatctacatgtgagtattctatcttttgtcttggtgttatggatcttgatcttatccccagccttgacgaagaggaagaaggtctttccgagttactagtccgagagtcggtggcttcaccaataccatactgtttcatactactacccctactattagtgttattatctctatcaatagatatcgtggattcgatacttgggttcggaatgatgtcagcgtttaaataggcatcagagaataatccgtttgagtcaagtttccttcgaggtgtcggtagtttcataacggtgttgctacaactacggggcaaaggagaaggatgcctgatatcatttgcagttggtgtttcttcaatggaagaaaccgggaaaggaataggctccagatgagacttggagggtgcttcaaaggacgcacattggtcgtgttggacttgcaggggagtagaggaggaatatatgagattctcggcttctggttgttgagagtgaatttgcggcagtggggaatgaaatatggaagaagaccttaaattcattgggtgagttaggattgcatgcttatttatttcaatttgctcgcggatcagttgtaccacatagttgttgacctcgtttttaatctttaaagaataggtcattgcgttatccaacctcaacacggcatccacttttttccttgccaagtccagagtatcgtgaatcaaaagagctagtccaggatcctgatcatcattgagaaaaaatcttgattgccacgacgtgacgttttgaatgttgtggttagtccttggggaaaactgaaaatatgaattcaagctaactgtatctttttggatagggaattgatctaacaaagcattgttattattattattattattattattattgttattattaccattatcttgaggaaatgttgaaagactgtggtaaagatcaggaaccatttcactcgggttgatatctatggcgtcctgacacagctctcttaaggagtctaaaacttggttaaggaagttgttggaacgtacctgtatctgactgcccttatactctgaatctttcgtgaagtttgccaagatcgcctgttgctcaagaagattatcgtgtagtaattgtatgagcgattccgttctatgctcgcaaacgcaactttgcgaatgggtctccaaccaccaaacagggacaaagttctcacagacccggcatagttccatttttggcagaggtagattgaactcgtctattatcatttccagtcgtattctcttcaagtactgcacgaagatcttagcgccgaacccaagcgtcttggcgaactcttcgggaagttggatatcgatatcgtcgcaattatcggataactggatgaccatgtcgtcttgagcgtcttcgttggcataaaagtctgaccagtcgtttgtgcgaggcttgactatccacatcgtgtgagagggcaactgtgtgtggccatccctgattaagataccacgtgcttccaaggtcgttatcgtactttcatcgtcacagcctgcgctaccttcatagtcggctgcctttatcttgaacgttatagtgcaactggtgtcatcattcatgagcagcatgtctgtggccttttgaaagacacctttatcttgatcggatccgagaataaggtctgcaatgtacgtcggagaagagccactatcatcggcgactcctgtgatcgtgttccactgtggagagccatatcgcaccttgccgtccagttccagctccaagatcatacacggattcttctctgtggccagctgcagatatttttcataattggaggaagtcaatgagcttgggttcgaattcgatgatatcggggagagcttgtttatgccaagtccctctttcatagcctgagatccgcctgcggtgttacttctattgaacatctgtcttcctctactgggcttatctattctatcaaatgaggcaagagaaaggaaagggaaaaaaaaaaagggaaaatgcttgatgagttaggaattcagtaaaagcacccaccagaacctctacagcaggccttccaggagtggttaagaggatagagaattctgtatatatatatacgtctatatctatacaaaaaacggcagacaatgcagaagttgaaaatgctgtgatacgaacaacaacttatttttacaatgaaaaacaacaccaagctgccaaaagctgtatattaaagttaaagctccctcatttttagtaaggacgctttcttttcccacaaaagggacgaggaaaaaaagaaaaacctggaaatatagtcacgtgacatgaataaacaagacctagggcaatatggaaaaagaagctaggataaaaatacatttatgagggttgtaaggcaaagtggctcagcattaagtagggctaaaaagagtcgcaaatatacatcgtaccgagtgatgaacgtggttttgaacaccttgttctcttttgttctcgctccctacattcactatatattagaagaaatttcacctcaatggacaactcgagaaatgaatacagaaatatgttttttagcgaaattttcctttcttcttgtcttcttgttttatttaaacttccaaggctttaactcagtgtcaaacataacaacctcctcctcccccacctacgacaacaaccgccactatggaaatgactgattttgaactaactagtaattcgcaatcgaacttggctatccctaccaacttcaagtcgactctgcctccaaggaaaagagccaagacaaaagaggaaaaggaacagcgaaggatcgagcgtattttgagaaacagaagagctgctcaccagagcagagagaaaaaaagactacatctgcagtatctcgagagaaaatgttctcttttggaaaatttactgaacagcgtcaaccttgaaaaactggctgaccacgaagacgcgttgacttgcagccacgacgcttttgttgcttctcttgacgagtacagggatttccagagcacgaggggcgcttcactggacaccagggccagttcgcactcgtcgtctgatacgttcacaccttcacctctgaactgtacaatggagcctgcgactttgtcgcccaagagtatgcgcgattccgcgtcggaccaagagacttcatgggagctgcagatgtttaagacggaaaatgtaccagagtcgacgacgctacctgccgtagacaacaacaatttgtttgatgcggtggcctcgcgttggcagacccactctgcgacgatatagcgggaaacagtctaccctttgacaattcaattgatcttgacaattggcgtaatccagccgtgattacgatgaccaggaaactacagtgaacaagaacactagccccagcttttgctttctgctttttttctttttttttttttttagtcgtggttctctgatgggggaggagccggttaaagtaccttcaaaagcagaatgcagggttattggaagctttctttttttcttttatgctagtttttcctgaacaaatagagccattcttttcttattactaagaaatggacggcttgcttgtactgtccgaagcgcagtcaggtttgaattcatttgaattgaatgatttcttcatcacttcatgaagacaatcgcaagagggtataattttttttttctcgttattatcgctgttggtgggttttttcttttcatatatttctttttcgcttagtggtttctactgttctgtctccggttagtgtgtgctacttcaaccgaagaagaagaggcttttcaagaatgcaaacgtgaggttggcgcgccctcctacaattatttgtggcgactgggcagcgacactgaacatagctcttgaacaagacccttttttggctgcaaggagcaagactggctggggttccacctcaaagagccacgctctgctttttttctatctgtttgtgtcatatctatctgtctatttatctatatatatatttttttatataaaactataaagaattcttgatgtatgcccttaggttgggcagcttttcaaccttagacttgatgctaacgccgctctgttccttctcccgtgctcccgcaagcgaacatctccccctaactccgggccaatgagtgataactatatcaaataccttcgaaaggaccttagtcatcatatcactctcactctcacggctctctgtagtcctcctcgaggagtggccaagaatgttctgttccgcagtctttatataatcgcactggttgaagacgaaagctcatataattctttttccatagcctaaatacaccaacgatgactaaatctgtagatacgctgctgatcccaggccccattatcctaagcggagcagtccagaaggccctggacgttccctctttgggccacacctctcctgagttcgtctctatttttcaaagggtgctaaagaacacaagagctgtcttcaaatccgctgctgcctcgaagtctcagccttttgtgcttgccggctctggtacgttggggtgggacatatttgcctcgaactttattctttcgaaggcccccaacaagaacgtgctggtcgtatccactgggacattttctgacaggtttgctgactgtctgcgtagctacggtgcgcaagtagatgttgttaggcccctcaagataggcgaatcagttcccttagaactgattactgaaaagttgtcgcaaaatagctatggggctgtcacggttacgcacgttgacacttcaacggcagtgctgtccgatctgaaagccatttcgcaagcgattaagcagacttcgccggaaacgttcttcgtagtcgatgctgtatgctcgattggatgcgaagagtttgaatttgatgaatggggggtggatttcgccttgactgcttcgcaaaaggctattggcgctccagcgggtctttctatctcgctatgcagtagcagattcatggattatgcactcaacgacagcaaaaatggtcatgtacatgggtatttttcctcgttgagaagatggacaccaataatggaaaattatgaggctggtaaaggagcttattttgcaaccccacccgtacaactaattaatagccttgatgtagccttgaaagaaattctcgaagaggggttgcataagagatgggatttgcaccgtgaaatgagtgattggtttaaagacagtttggttaatggcttgcaattgacatccgtcagtaggtatccttctaacatgtctgcgcacgggttgacagccgtatacgtagcagatcctcctgatgtcattgcttttttaaagtcacacggtgtagtcattgccggaggtattcacaaggacatcggacccaagtatatccgtattggacatatgggtgtgaccgcttgcaacaagaatttaccgtacatgaagaactgcttcgacttaataaaactagctcttcagaggaaaaagtgattaccctcgtacttttcatttcatatatatatatatatatatatatgtacctatatattcttcttattatggcttttctaattcttgcaagattctttgacagctccatctttcgtttggtgaaaatgaaaccatccccaggatacaattaatgaacttctgcttgactttgacatccgcaatctcgtccagtcgaggcatattcctctcaacaatgctaatctgtacatctttctcctggtccagtacatacttgccatcgccatctgcaccaaacataccaacaaatgcatcaaccgagccgtgttgcgcaacctcttcccatttctgaatggacggtatgcccaacttttcgaatattgagcaaatcagtctgaaatcgcttccatctgagttcatgtcgtcgctgccgtcatcaatcatggccggaacgtgccccatacggcttgtttctctctggaaccactgagaaataattatcaacaacgaccacacgtccacgccaccatcatagcattttactccaaaaagcacttctggggccttgtaaattcctgtgcttatatccgtcaccttgctatccatgggttccgcacttgtttgtgagttatttgccatgtcataagagatgccaaaatcaattatgtacaactttggggatacggtgctggtattgtttgttagcatgatattttgcggtttgatgtcgcggtgaatgatcttgttctcatgtaagaatgcaatcccttcaaccatttgccggaaaaaggacaaagaataccgattgacgtccaattgattagtatatttctgaacgggggggtccgcaacaattgggatactgggatttagcaaatcgtaatagggatttttttttcttctatctcttttatagtgcatttgcatgaactcataaaggttcatctcttcaaagggaaacaacaacaataggtcattattatcggtagccttagactctagaagaggtaagatgtgcttacatttgttgcccagtttgtttaatatcgatacttcgaatttggcgttatgtggcgggatatcgaaatctagtgctagacatttaatggcatatgtatccgacctataaatcctagcagttctagtagatttgaccaactgacagtgtgtaatgtctatactatccagtttcattaagatgggcgtgaattttgttgcctctcttcttcatctggcctctttgcttctatgagacttctgtcgttttcctttttttaggatcacaaactacttctataacttaaatagtcaaatcacattttccactaagatacatattttctatacagggggtctttgcagttatatatactcagttatataccaatctctttgtcaggaatttgattatcacgtttcaaccattctagtgctaatggatgcaaactattcactttactaataacaaccttattgttgtcattttcaaaggccacttgtccattaactttagcattgaccacttcagagaactctacgtctttctgataatctaaattatccacaatcttacctgatttcatatggtatacttggttaggccatttggccaagccgtcaaaaatatgtgtagcgtagaccactgagcatcttctggtttcggtctcccactttaaaaactccagaagtcttgctctggcaataacatcgagatccacagtgacctcatcaagtagtaaaactctccaaggtttcaagagccccatggctaactgaactcttctcttttgtccatcacttaacctgtgcattctccaacgtacatcgatgtccaggattctaaccaatctttcacctctttccctaaaatgatcgaatccaatactttttaatagttccaagacgccgatatccctattaatgatactcatatggcaccattccgtacctagataagtggtcgtttggtagttcgtcgaatcttcaacactttcatcatcgtccacttgattcatagataatggactgaatggatcaagaccattgaccaggatttttccatcaaggcaaagatgcttaccgcttagtaatttcaaaagggtggatttaccagcaccattggcacccacaactaaagatcttgtattccatgggatttgaagattgatatcaacaactgacggatcggagctttctttgaatttgtacgttaggttacgcacctcaatagcaaattgggaaaccatcttgagagttatctaatatcttgatatcttatgcaggagtactggttttctccatactaaaaatctctctttcagaattttcgttttttcttatttgagtcatcctcgaagaaatttccgcagcgaattttaaagaagcactttataataataccttacatatgagtttgtttctatgtcatgggtatataaggtatattgtatgctatctagttggatgccccagtttcaaaatgtccctaatcggatccacccagatgtgactaacgtggtgcaaatttatatttatatgtgataagtctttcaactttgtggagatcatgtaacgtagattgagtactaaactcaacgaccttgtagtccgtaattggtacaggatagctacaatcccgataagtaaagaaattttgctccacctgttatatttggagggtaaaaaatggccaagtctttggaccaacgcccttgtcttggatctggcggcgacaccatgatacttttcttccttgtaatgctcgttcatctttgtttgttcgctcaaatagaagataatggtgctcatatcgaagcatcctggctttccacatgctgtattgagtaatgcactatatttattaagactcacccgtttcaaagccttcttgctggcagtagtcgcatcttttctagttatttgcaagacttcttcccaaagcgcctcatcatacagttttttctgtaaaactgtttgtatagcaccatggcgcaggtcaaaatcgttctcgaagaaatcagaattagcttctatttgcttcgaaatttcagacgcattttgcaatagcaggttcttgtatatgatcaaaggtaaacgcatagattgcatcgatattgtcatgtcaaatatctggaaaagaattttatgaagattgttgtcaccgctatctataggtttcaaattatgtgcaaagattgtcaatattgacccaatagcgaaaaggggctcattttcgtcaaatttgaatagattatagaatttcatgtttgattcctttatcaatgaagagattactctcaattgctcaaatgaaaaatctagtgagttcatcatgaaatccctcagatataatagggtaaatgcttcgatgcaataaaacagcctttccatatcaatttcttcttgcaatgagagattttctagttccagtccgttctcttttgtgacattccaactaaaacacatgatgaaaacagacacaatatcatgataaccttggtaatagttcaacgttgggtactttctcaatacccgagtaattaactccaccagtagttttctcaattgcagtttcaagtttttgtcgacaattccaccaaaagacctttctgcatccaatatcacctgaccttcatctttatgtttttccactggtgtaatgtactctgttgcatcatcaataagcaactgggacgccaataattcataccaacaatcttttcttaatgagttgtttacaaaccccagaggccctaaacctatgtacctcaaagctcggacatcttttttctctaataactttgatataacttttcctttttgttcttctgcctttccactgtcacaacgagaaagtgattccagatatgcgttataacctccccttgtcaacgcgtctttgtcgtggctactctgattagtatgaaataatgaccttaatggcatcgtattttgttaattggcttgttctatgtcatttgctaaattttctctttatttctttactttgccaattcaagataatcttcccttcccagagagaaaaaaggaaaaatttagctatgaaacctcaataagctttttaatacaccaaagattcaagataagagcatagaacgaactgtagaatagtccggatatgttatccaatgcctgccaaaatgcattgtcacacgctgtagtgctcgaataggtgttgcaatccgtcaatatacgtcttgctctgtgggtaaatgtctcgtgcattaagacaggctagtataaacgagaagaagtatcctgctttgcaatgaaacaatagtatccgctaagaatttaagcaggccaacgtccatactgcttaggacctgtgcctggcaagtcgcagattgaagttttttcaaccatgtaaatttcctaattgggtaagtacatgatgaaacacatatgaagaaaaaagctttcctacatattcaagatttttttctgtgggtggaatactatttaaggagtgctattagtatcttatttgacttcaaagcaatacgataccttttcttttcacctgctctggctataattataattggttacttaaaaatgcaccgttaagaaccatatccaagaatcaaaaatgtctgatgcggctccttcattgagcaatctattttatgatccaacgtataatcctggtcaaagcaccattaactacacttccatatatgggaatggatctaccatcactttcgatgagttgcaaggtttagttaacagtactgttactcaggccattatgtttggtgtcagatgtggtgcagctgctttgactttgattgtcatgtggatgacatcgagaagcagaaaaacgccgattttcattatcaaccaagtttcattgtttttaatcattttgcattctgcactctattttaaatatttactgtctaattactcttcagtgacttacgctctcaccggatttcctcagttcatcagtagaggtgacgttcatgtttatggtgctacaaatataattcaagtccttcttgtggcttctattgagacttcactggtgtttcagataaaagttattttcacaggcgacaacttcaaaaggataggtttgatgctgacgtcgatatctttcactttagggattgctacagttaccatgtattttgtaagcgctgttaaaggtatgattgtgacttataatgatgttagtgccacccaagataaatacttcaatgcatccacaattttacttgcatcctcaataaactttatgtcatttgtcctggtagttaaattgattttagctattagatcaagaagattccttggtctcaagcagttcgatagtttccatattttactcataatgtcatgtcaatctttgttggttccatcgataatattcatcctcgcatacagtttggaaccaaaccagggaacagatgtcttgactactgttgcaacattacttgctgtattgtctttaccattatcatcaatgtgggccacggctgctaataatgcatccaaaacaaacacaattacttcagactttacaacatccacagataggttttatccaggcacgctgtctagctttcaaactgatagtatcaacaacgatgctaaaagcagtctcagaagtagattatatgacctatatcctagaaggaaggaaacaacatcggataaacattcggaaagaacttttgtttctgagactgcagatgatatagagaaaaatcagttttatcagttgcccacacctacgagttcaaaaaatactaggataggaccgtttgctgatgcaagttacaaagagggagaagttgaacccgtcgacatgtacactcccgatacggcagctgatgaggaagccagaaagttctggactgaagataataataatttatgatcaaaatttacggctttgaaaaagtaatttcgtgaccttcggtataaggttactactagattcaggtgctcatcagatgcaccacattctctataaaaaaaaatggtatctttcttatttgataatatttaaactcctttacataataaacatctcgtaagtagtggtagaaaccacctttgcttttacgagttcaagcttttttcttgccatgatctagaactctcaggcaatatatacagttaatctttttttactgggttgtagttctaatgtattgtttcgaaaaatagcaaccaggcacatattatgttcaccaagtggtgtatccagtacagatttcttattccataaatgaaactgaaaacggttaagtacacaaataaaatgatggtaactttaccatcccacgtgtctaaaggtacgctgtttggcattttgaaaatagaattatttccaaccaaaaaaataattggtgccactgctagtatattgtgatgggatctaaatgaagtttcccatttgatggcaacattatgcaggaaaacaataatgatagggatgttaatggcactaacaaataataaaagcagaagcaacgtcatattataatttagtaagttcaatttctgctcgttgtttgatagtttcaacagcgctactctaatgcaggtagcaatttggattactaatgagataacaaacgccatctggtatggtatgtgaaaaaataccaacagtaataaaagcacagatgccattaatcttcccttaccatacgctttatgttcaatagtatcaaaagcctctttatcttcagtgtttttctttgataacttccgttgaaggaatattactaaaatttccaaggatccaaaaatcttagaaactagtgctagtaatccaactgtcataaccccaaagagaattccaatagttgacataaaccaatctctgatccccaaataataaaaatttgcatgcatgtttctctcggatagcagaaatggataatttaaaccgacaggatccaataaataaagtattcgttgtaccaacttattattaaccacaggcgaagctaagaacagcgtaaaaaacattaatattccgtgctttcttaaaatatatcccaaagtgctatcaaaggaaggaaactcagatgtcttgttgtaccagtagaactggtatgacagtacgagtgctataaacgcgactggaaaagatgctagtgctaatctgtacctgataaacagcattttcaaagttaaagaccaattaatagtcattttagcttctaaggacattccgggtggaataaaaaaacttaattgtagcgatctcggttcgctttcatttaatgggataaacggtgctacattatgcatatttatatcgagacttttgtttataatatttagatgccatttagactcgaaaggttcgtaaacccattgccttatgaaaggctgaaacaatgtctcttcggaagcaataccttcgttgcttgcctcaatcttggtttctaatttgtacgataataaagaatcccacaaattactgaaacttataacctgctcgatgtctttgccatccaagtgtagttgttctccaaagagcaatatttgagaaggtgtagtattgactatttgtacattggagacgttgcgcagtaatgccaaaagaaacccctgattgtcctccatgccttcttgttctgaaaattcaccgtaagtgggtttgcttatcatcaagtagtcgtacttctgtagtatattcttgccaacactaacggctttaaacggattttttgcttctccaaaagaagaatcagctgcgaactgagtatcttttgaagacctgggcactgttagaatactatcaacagctgttatacagcttagattcaccctggactctgtacagaaatagatcataggcatatcgagactagttaataatgtgaaatgcaggtgttcagtggaggagatgttactcggaatatttatttttgtataattgttgtgccacttttccaggttaaacatttcaaaatctaggacatcgttcatttccaaagtagcgtaatcagaaaagaagttgtcactaaattcttgtaagttttcttgaggataatttaacttactattcatccatgagtagtcttcaaaccctgaaagcaatagttttctagcgatttgcaatctctgattcaatggcttaactttttcaggtttggaggcatctatactttccaataaaaggcgcgctagtacctctcttaattgcttgcaccaaacaatggctaaatgatcaattggagtccaaacatctggaatagtagttgtgaagctggtgaacccattttctaagctaaccaaatcttctacagatgcataatctgcaggtaaagtagtatccaatataccgcctgtaatggaaaccaatgaaatgttcttagagaaaaaagaatcgttttgggataactgctttctccaatattcgtttgtatttttgtaaagctttaaaatgtcaccatcaaaggttactggtgaagcagcatgaggtgatgataaggtcaatatggtgcttatacttcccggtacgtggttcttcaaagttagcatgaccctggatacaataccgcccatggaatgtcccacgataataactgactgcggttttggatgtgggtaatcaggggtcctttcgtaaagagacaagatgtacttaatggcatcatttaggtattcagcttgatcaagcattgtttcaccatgaaacgcagtgaaatcttcattgaaatctgccgtaaagaagtccaaatttcgcacattttcgttacgcagagtcgccctggtattggaatcaaaatatatattggagcaagcggaagcaatcgatctgcattgcctaaaagaacctgcatttccgggtataaaaagtacagggataccatcaagttgtaactcatcaccatttaaaggttctcggtctacgctttgttctcgatacaagtaaagatgatacttgtgtgccagtggtgtatacctctcgtcaaatccatcgatccttgcgtaagatggaaacatatagatagattcacactgaggagcatctgcaccattaaaaggtttcagtagcgatatcaataaaagcgagcaaatgcttaaaatgccaagaatagagaaaaggcgatatgtgtaaggtttttttgctatcttatcattgttcatatatttgggggaagctttatcctggtcttcacgcgtagcgagtactctcgagtattgaccagatgagttaactttattaattatgggccgcgttataacactaactaatctcctgatacccataacgaaatgaagatttttgtatgatggtaagcctaagatataggccaatgctttaaagtagagggagtatttcgagtgtgaatttactatcagatggaactgcaaggaatgtgttgagactcatttttactttttcttgttatgacttggttggtatatttagacctttttcaaaattcgcgccatacaggaaaaaaaaatggataataagaagaaatgcatttatttgagggtacctagtgagttatgcaattgtctatataagagtatgaatctaacttaaatacatcaagcatttgggatgaaatcatgcgaaaaatcaaaaggtcacaaccgtgtgaaatggaaattaaaaaaaacgttaaaaatatgtagtcttgtgaaggtgataatattacagccggatgatacttgctatttttcttttgaaatttattgtagttatctttttttgttttttgttttttttcattattattgcgttatcggtgttcatttcggtgatttgaatcttcagtaatgttgcctcgactttcgtagtaaactttgaatgtcaggtttgttaaatgccaatgcgtagaaagatgttcgagaggtacaaagttgtgctgctcatgatgaatttttctgggttatagaagagttctgtttcgcttctgaattgattaacgaatcatttaatttttttagggagttcgaagaatttgaattattgttctgtgatttctgcttttgttgttgtgcttgctgctgttgctgctgctgctgttgttgttgctgttgtaaatgttgtatatgcttttgtttcagtctggtgatatagtccctacgatactttatggtggcttcccttaattgttcgtaggacttcgtacccaacattgttccgaatctaatcacctgagtatcatttgaaatctggttaagtcttgccggttcatctgaaaacttgatcccatattcattttgtggagaatcatacttccacttgtcgtaaagtctgacaaattcgtcgtatttggaatcgtaaacattaatcgagtcagtatcgttactaccttctcttgaatattgttctttttcgattgaatcgaaatctacaaaatccattaaagaacatgcagacttggtcgacgatgttgtaaaatttggcatacgatcaacatacttaatattagatctaccaactctcttcctgaattttattggatactctctcgaatgaatttccaaattttcttggaatgggtcgtacagttcagtttttttgattcttttggtatccaagttgtaattatctttgtttctcgaacggccatttgaatcatatattctgatgtcatcagatatccccttcaagtattctggtaaatgtgaagaataaaaagatctatctatctgaaacttggatgacgcgatagatgcaaagggaacattactagtcgaaaaatttttaggcaacgacatgtcaaatacaggattaaagggatcgtccgttaagttgaaaaagacatctgcgtcttcaattttccgtttctccatcttttcctgaacgaactttcttgcatttttttctttgctgttcaatagagcatccacgtcttccaatacaatgtcaggaattttggaagatggtagtttgacataaacatgagacgtaattggctgtgatgttgaagaagaggatgcattcgcgagttgctttccgttttcagtcttaagggcattttgctgttgttgttgttgttgctgtaacagttgctgctgttgctgcttggtgagcctagaagatttgtcttcaagttggttattccttttattgttctttgccttcgctgccgctgctgcagcagctgctctcttaagttcagctttccttagttcagcttccctttgttcgaccgtaacaatcgtggggcgttttctcttgtggttaatcaagtcatcgtcttctccactaatgttcaaagatcttttcaaattcttaatttttaccctttgatcgaatatttttaattcatcattaatccaatttagggaaacgttctcacgtttagcaacaagcagggccaagtccttcgcgtttttcaattcttgatgcaacgcccttaaacgctgactgtttaagatatctatacgtcttgttttccgcggatgtctcacttctcttcttctgaaacagacgtagggatcaatctcttctttttcacccggcctttcaaatttcagctgcggaaaaatttcgtacccgttaacttcaatttttctttctctccaataatcataaattttagagccgaacttctctatcagctgaattaaaggtctcgtattcatttgagatacggggtcgaattgtgtgataaaatgtgttttatgagaatttatttcatgattcagctggtttcttagattgaaatcagccatatctgattttattaatgtgggcttcaattcttcaaaagaaagtatactttccggatccatactcaagaatggttgacgctcgtgaatagcatgttcaaaactggaacaaagtatttcaaattcgtcttcagttaaaatgtctgatgaacctttgttgacttgttcatttaaaaaggtctcatctctttcatccatattgtagttggtaccacagcaatcctccacagtggcagaaaatttgatgtagctggtggtctcctggaaactgcccgtataaaacttatcatattcattccaagtcatagaagcatccggggtcggaatatagtctttgtgctttgtatgaccagaacccatttgtaatattcgatgcaaatggacctccttttcttcatttttttctacaccagtttcgatctcaaccacctctctctgttgcaattcatctttatccaggtgtttcagatcgttaggcagatatatcttaagatgttgcttcacagatatttttcgatgtctaaatcgactattactgctaccagcactggctccagcacctgaatcgccttttgagaatgaatctagaccgtcatcgtgcgcactcctagatccagaccgcctagtgcttctaccagatttatgcgaaccgtcattgatctctatagcgtttgaaggtgtcggcatcgttattatcgttatttgctaatgttattacaatgtttttataagcacgtgactataatgttaccctatcgtgtgcaatttttatttatgttgacctgaagtccgcagttgccgtacaatgtgagaatatggacaaaaggaaggcgagggtggcaaaaagaggagtcaaaaatagatagcgtttattttattatagcagctcagaggaacgcgatgtggtgtaataatattgcgagtgtctaatgaccaccagaatacgagcacagttttggctgatttttgcaaacttttttgcttttgtgtagtaacctctcacaggtattgcttgtatgctataccatgtgatatgtaatagtacaattttgtggtcggatcgtgcttttgccacccgcggccgacggagaaaatttttttcctctatccctttgtttctcgcttactcctgcggtatggggtgctaactatggtgagcgagtatgggaagaagtagcgatatacgggtaaccctaatgtttgggtgttttgaaatttatccttggaggataggcgatgagctgctcttaaaggttttaacagagagtgttgtatgaatattctgtagaattttatagtaaacaggtatcctcagactgtaatagccatggatttgttagcggccagcgtagaaagtacgttgaaaaatctgcaagataagagaaactttctttcggaacaaagagagcactatatagatatcagaagccgactggttagatttatcaatgacaatgatgatggcgaagaagaaggcgaaggccaagggatggtgtttggtgatatcataatttctacgagtaagatatatctaagtctaggctatgagtattacgttgaaaagaccaaagaggaggccatcacgtttgttgatgataaattaaaactaatggaggacgccattgagcaatttaacctgaagatcgaagaggctaaaaagaccttagacaacttgaatcacatggaggacggaaatggaattgaagaagacgaagcgaacaacgacgaagattttctgccctctatggagattagagaagaactagatgacgagggaaatgtcataagtagttccgttacccctacaacaaagcaaccatcacaatcgaattccaaaaaagaacagacacctgcagtcggtccaaaggagaaaggattagcaaaggagaagaaatcaaagtcattcgaagaaaacttgaaaggaaagttattgaaaaggaacgatgaagtaaagaaaaaagtgcagccatctaaagtagatacagaaaacgtgtatacatttgccgacttggtccaacagatggaccaacaagatgaattggaggacggctatattgaaactgatgaaataaattatgattatgatgcgttcgaaaactccaatttcaaagtcaatgataactatgaagaggatgacgaggacgaagatgaagaagagtatctaaatcattctattatacctggctttgaagcgcagtcctcatttttacaacaaattcaacgcctacgcgcacaaaagcaatcccaagatcatgagagggaagaaggtgacgttaataaatcattaaaacctattttgaaaaagtcttcttttgctgagaattcagacaaaaagcagaaaaagaaacaagtcgggtttgcatcttctctagaaattcacgaagtcgaaaacttgaaagaagagaacaagaggcagatgcaatcctttgcggtgcccatgtatgaaacccaggaaagcacaggtatcgctaataaaatgacatcggatgagtttgatggtgatttatttgctaagatgttgggtgtccaagaggccgatgaagtgcatgaaaaatataaagaggaactgataaatcaagagagacttgaaggggaagcaagcaggtcgaatagaagaactagggtgtccagattccggaaggatagagcttctaaaaaagaaaatacgttatcaactttcaaacaggaaacgacaaggtcagtggagaacgaggtagtggaaaaagagcctgttgtgggggatattatagaaaaagaacctgttgtgggggatgttatagaaaaagaacctgttgtgggggatgttatagaaaaagagcctgctgtcaccgatatagtggaaagggagcctgctgtcaacgatatagtggaaaggaagcctgttgtgggggatattatagaaaaagaacctactatcaacgatatagtggaaaaagaaccggaaattaacagcaagagcgagtttgagactccttttaaaaagaaaaagctaaaatcactgcaaaaaccaagatcatcgaaatcaatgaaaaaaaaatttgatcccaaaattctcgaaaatataagtgatgacgattatgatgatgatgacgatggtaataagaaacttttgtccaacaaaagtaaaaataacactgatgagcaagataaatttccttcaaaaatccaagaggtgtctaggtcgatggctaagacgggcgccacagtagggagtgagccggttagaattacaaatgtcgattatcacgccctaggtggaaacttggatgatatggtcaaggcatattcattggggttatatgacgacgatttagaggaagatccaggaaccatagtggaaaagctcgaggatttcaaagaatacaataagcaggtggagttgctgcgtgacgaaattcgagactttcaactagaaaacaagccagtgacgatggaggaggaggaaaatgatggcaatgttatgaatgatatcattgagcatgaatttcctgaaagttacacaaatgacgaggacgaagtagcactacatccgggccggctacaggaagaggttgctatagagtacagacggttgaaagaagctaccgcgtcgaaatggcaatcatcatcacccgccgcacacactgaaggcgaattggagcctattgataagttcgggaacccggtcaagacaagtcgtttccgctctcaacggctccatatggacagtaaaccataacccatatggagacagaaagtaaatcagaatctatattaacatatacgtatatatttgttttgtgtacaataactactacaaaattggggacagacgatataaaactagaggaactgctgagcttattcgtacaagtcttcgtccaatctagcagcaggattggtttcgataaagtccaaagagactttatgacctaacagttctctgatgttttgaaccttatatttgatcatggtaggtctttccaaggataacccccaaccaaggactcttagatcctttggtagacccatggactcgagcatttctggtctgaacataccagagttaccgatttcgacccatttttgcaaaccttcgtgccaagaaaagatttccattgatggctcggtgtaaggattgtaggtaggcttgaatctcaaaccggtgacacccattctttcgaaaaactcttccatgaacttgatcaggtcacccagagtaatgttgtagtcggcaagaacaccttccacctggtggaattcggccaaatgggtggcgtcaactgcttcgttacggaaaacacggtcgatagaaaacaatctggtgggctttggatctttggccaaatcgtgcagcattctggcagagatggctgtggagtgagttctcaagaccaatttttgacattcttctggcttccagttgtaacgataaccgatggacccgaatctcccctgttcgtgaacggctttgatattgtccatgtatgtcttgtcatcgggcaagtcagcggttagtgggtccttgatgtagaaagtgtcttgcaggtcacgagcaggatgctgttgtgggacgtaaagggcatcgaagttccagaaacctgtctcgacgtattggttcgagggcatctctgtgaatcccatggaaaagaaaatttgtctaaattcctctctgactttgtttaaggggtgaagagcacctgaagatatttgcacaccttgagaattgaaattgtaaggcttgaacttcaagtccttgtatgcattggtggagaccatgtcggaggtaagatcggtttccaatttggtgaggtcggtcgagaactctggccctttggtaacgttgaaatctgtgattttaccttgagcaattaactttcttttcttcaagtcgttcaaaatcttggcgtcaatgctatccagatgcgagttgttcttgatttgcgctagaatagattgcgtttcatcagtaagctcatttaaatcggtattttgcaattttgcggagagttcaagctcgtttgaggcgtttttggcgatccagccgttcttgaaagctctagcctgaccgaccttaccaacttgaggacccagtttggacatcacatctttgatttgaagttgacccaactcttggatgagcttgactagtttaatttcgtacgaaccttcattcaaaatttgagcaccttctttggtcaagtcatacgtaaccgtgtcgaccttggaaaactctaacttgttgtgggctttcaaagagttcaaagcggaaagaacatcttgagagccgtgctgagggaaagttgccagtgtggacttgatctcatccaattcatctagtttttttagaatttctaattggaaatcagacatctttacgttagggggtgagagagggaggggggtgcctttaatgtatatatacgtaagatatatatatatatgtatatatatggaaatgtattcacaactttacatgtgcattaaccacaagtactgcgtacgttcaagattacagcaatgcgttttattaatttttcaagcatttttcacgtagagaggaacaaagtttactgaaaagaaaagaggtagagaaaaacagaaaaattttttttttctgtttttcctgcctcttttctttgtttgattcaatatggtcgaccgggtaaacccctgataaaacgataccaaagccgggtcacctaacttatggccaaatgcgaccggtcccgctttccgattttagccgccgaagacgtacttggcgccataattaaaacctagcttgcccaatacttctgagttctacgtggtgcaaaaatatttttttttttttgaaaaacctaccctatttcattatagatgcatccatcagtattacggtgtcctcacacaaccctgtctctgcacaacgtaatacctccttttcccgtctgctagctctcatttcgcggtaatccaacttcaaccagcaacccggatcttctatacgcagtccggtgtgtgggtgcatgactgattggtccggccgataacaggtgtgcttgcacccagtgcccaacgtcaacaaagcaggaacaacgggctgataagggagaagataagataagataagataacaaatcattgcgtccgaccacaggccgacacatagcagaacgatgtgaagcagcgcagcatagtgttagtgccggtgcagctaccgctggtattaacagccaccacaatacagagcaacaataataacagcactatgagtcgcacacttgcggtgcccggcccagccacatatatataggtgtgtgccactcccggccccggtattagcatgcacgttttctttcctttgcttttccgcccttcccctgttctgttcatcgcatgtgcatatatatatatagatatatatatacattgtacacggtgcacggtagtgaacataactatgagcacgaacagagtcccgaacctcgacccggacttgaatttaaacaaagaaatctgggacctgtactcgagcgcccagaaaatattgcccgattctaaccgtattttgaacctttcttggcgtttgcataaccgcacgtctttccatcgaattaaccgcataatgcaacattctaactctattatggacttctccgcctcgccctttgccagcggcgtgaacgccgctggcccaggcaacaacgacctcgatgacaccgatactgataaccagcaattcttcctttcagacatgaacctcaacggatcttctgtttttgaaaatgtgtttgacgacgatgacgatgatgatgacgtggagacgcactccattgtgcactcagacctgctcaacgacatggacagcgcttcccagcgtgcttcacataatgcttctggtttccctaattttctggacacttcctgctcgtcctccttcgatgaccactttattttcaccaataacttaccatttttaaataataatagcattaataataatcatagtcataatagtagtcataataataacagtcccagcatcgccaataatacaaacgcaaacacaaacacaaacacaagtgcaagtacaaacaccaatagtcctttactgagaagaaacccctccccatctatagtgaagcctggctcgcgaagaaattcctccgtgaggaagaagaaacctgctttgaagaagatcaagtcttccacttctgtgcaatcttcggctactccgccttcgaacacctcatccaatccggatataaaatgctccaactgcacaacctccaccactccgctgtggaggaaggaccccaagggtcttcccctgtgcaatgcttgcggcctcttcctcaagctccacggcgtcacaaggcctctgtcgttgaagactgacatcattaagaagagacagaggtcgtctaccaagataaacaacaatataacgccccctccatcgtcgtctctcaatccgggagcagcagggaaaaagaaaaactatacagcaagtgtggcagcgtccaagaggaagaactcactgaacattgtcgcacctttgaagtctcaggacatacccattccgaagattgcctcaccttccatcccacaatacctccgctctaacactcgccaccacctttcgagttccgtacccatcgaggcggaaacgttctccagctttcggcctgatatgaatatgactatgaacatgaaccttcacaacgcctcaacctcctccttcaacaatgaagccttctggaagcctttggactccgcaatagatcatcattctggagacacaaatccaaactcaaacatgaacaccactccaaatggcaatctgagcctggattggttgaatctgaatttatagatcccccaaaaaaaaaaagtactcgcttctttccatgtccgcttcatatatatatacacatactaatcaaactctatgtatacatagaataaaaagaagaacactatatttatttcataaaaaaaaaaaaaaaataacaaaaaaagtgcaacatttatcaaaagctcagtgtgcgttatgcttccatgtgacccaacatctattgcggcggtgacagaatagttgaaaggcgcagggctcacacacaggaatggccctcccaaatttaaaagagaactaaaccagttatcctaggcaattactttatttgagtcttatatgacgtcactagaagctcagtaagagcaaccgagacctgaacatccttttttttttgcttctttatttggcagcatttttcaaaaataataaaatggaagccgcgagtacgaacaatgatgtgttctgggaatacctcgtcaaaacaagacaatggcaaggattttctttcatcaggcagaaagatctggatctgaatggcatcattttgtgatgtgtaaaagcgggaccttgttatttcgactttttgcatcatgttgatgcaatttgctacttttccgacggtgcgctccaacggatgggtatttccttaataacaaggcatttctctggaagttggcttactgtttgaaatcacagccggtcacaaaataaagtaaaaaaactatctctctccacaagaagtaattacaggttgtatactacatatgatcgtatttctttatgaacactaaggagtttcccgctgtgtaccgcaatatccacacaaaaggaaggaagaaacttctgtggcttgacagataaataactgcagtagtcggtgcgtactaattgtttggtcgtgtctgaaaaatcttgaattttcagaaaagaataagccccaaatgtcagtgatggtagtagcagtactcccctacgattttagatactttagagagcccaccttcagaatcggaaggaggataattttgtaaagcccttctgttttttctcttgcataacttatatttccacatcaaaaagtagtgtgctaagaaaaaggagacgagaaaaaggattacggcactctctgcatctagacatataccaaaagttgggtttgctcacgaaaataccataattgtggtgtcaaaaaaatcctgcctcataataccactgcagcaattgtggatgactaaaaaataacttgcattccacgatgttattttactttataaagcacctgcaatttttttttttgtattaactcatcgagtatgtctgtgtaaactgaaccaggcttaatatcgtttctaattcttgttgtgagaaaactttcctgcctagtgtatttcgtcagggcgaaccttcggataggcaccgaactccgagattcttgctccaatttaagaaataagctttttccgtcccaatacaatagaacattattaaagttaataataaaaatggcacggcaccagttggaagttaaatcccaacatttgctgcaagaatagaaaagaagtcataacaaatttgcatattacttacggcttcaaaaaagcaccgaaactaatcgagaaagcttataatatcggtatacatttgaatgtattttaactatttctatatcaaaaaaaaaaaaaaaaattgtatatttttcgttattctctaattcgtatcacattttatccctaagggaatctatctctaatttgcaatagtgtagataccgtctgcggatagagcgctagagatagctggctttaatctgctagagtaccatggaacaccagtgataactctggtaacttggtcggcgggaataccagtcaacatggtggtgaaatcaccgtagttgaaaacagcttctgcaatttcaactggataagtttcagttgggtgggcagcttggaaggagtagtattcagccaaatgagctctgatatcggaaacatagacacctaattcaaccaaattaactctttcgtcagattgagatagtgtagtggttgctgcagcggaggcaccagcggcaatggcggcgacaccagcggcgattgaagttaatttgaccattgtatttgttgttttttgggttgttgcttagtggagatataagcttaactggaaggaaaagaacagagaaatgtctcaaacaaagctgatcaaaccgctgtatttatataaattttttgagcaattacatcccaaacaggctattactggtcactcattttgcactcatatctcacatattctaattcctggccacttagccattattactatgggggtgtattttccttgaacgatgctgcacttcgtataagaaacacgcttcatattccccatatcttcgtatgtttagagcgcaagaatgttccttacagtaaaggtgcctttcgacctgcagacacaatgttagccaagtaatagaagcaaagccaatattgtcttggcctcgttcaattgcctaacccttggcactaaacggttgctaggagaaaaaacacggaccttttcccaaattagaaacactaaaaaatgttaatatggtactagtcgtcgtaccctgctgaaatcataaaaaccttacgccatctgtgggactcgtcatagggtttagtgtatattgaatgttggaaaatctctcgttctgatatgcccaacaaaccaacaatgtacaatgtgaggtttctacaaatcaacaactatggtttcccctaattcacttggattgattggttctagtgaaaactttacctgttacaaagttttgaatcattttaattagatatcgtgtaccgaacagtatctgattcgtataaaaaaaggaatattgaaggtcagttatcctagtgacaggtgaaaaaaaattgatatgtatgccctttgtattatctttggggtggaaagaagtgaaaacagaagcaaattggttttgcagtaagtttagtcttttgacctgtaactggttaatttcgaaatgactggtggagcctgactcgaatatagagcaaagggagtctttagtagtatatcttcttacttcgatgatatttgaataaagttcaactatcatctaccgattagtattcatattactactatattataatatgggtgtgagaatatggcgtaacgtttgagagatagtctcaggtgtagtggaagctgaaattcaggggaatgatgttgtaatggaataattaatgacaggatatgagatggaaggaaatttaattatattattacatagaaatatcgatttccttttgtgaatttctatatcctcgaggaaactttctggtatactttgtatactaaattttatagcctttgacaacaacgaaatcccaaaaagtatttcataattcatgtacttacgagaagaaaaatcattgccctgctagtgcttcaaaaaatataattgggagcaactaaaatctccttgcaatgagttacaaggaacagattcttaccggtagtcctggtgagcaaaagacttaaccatgtggcagccgttgtctaatatccactagctatacacttacatggaatattggttgctgaaataattagacttaatggtagcaaacgtagtggtcatccatatgaatatatgagcaagaaataaacgtgaacatgtaaaatagtaatacagacaccataatgtacaggttaatcctgatatgtttctcgaatgaaatcgggaagactaataggaggctcaattctatattcactcacgttatgcgcctgaatttgaatggatattgttgatagaagattccctttaatcactctcctatataaatatttctgtttttcttattaacgcaacaataattcgggcgtgtggtctagtggtatgattctcgctttgggcgacttcctgaataaacaggaagacaaagcatgcgagaggccctgggttcaattcccagctcgcccccttttttttgcatatctggtcataatatcttatctgatcgactagtagtttcctcatatattaattccttgtgcaatttttttttacttactcaatactaagcggttcttcataaatatatatactatactgtttattatttcctgttttcaacaatgaatagctttatcataggcagccatgttagcttccttaaatgcttcggacaaagtaggatgagcatggcagaccctagcaacatcttctgcggaagcgccatattctaaggctaagccagcttcagcaatcatttcaccggcatttggaccgataatgtgagcccccaaaatacgctcggtcttggaatcgatcaaaatcttcacgaaaccttcagtgtcttggttggtcttggctcttgaattggccgcaaaggggaacttaccaattttatagtcaatgccggcttctttcaattgctcttcggttttaccaacccatgctacttctgggtgagaatacatgaccgaaggaatgttgttatagttgacatgaccgtgaccagttttcaacatttcgacagctgcaataccttcctcttcggctttgtgagccagcattggaccaaatgtaacatctcctaccactttaatgtgtgggaacttggaattaaattggtcatcaatgactaggcgtccccttttgtctacttctaatccaatcttttcagcccctaagccagcaatgtaaggtcttctaccaacagcaaccagcaaaacttcagcttccaaattttcttgcttattcgttttagtatcttctacaacaatttcgacgacgttcttgtcgtcgtttctctttgcagaaataactttggtgcttaatttgaagtccaaaccttgctttttcaagaacttttgggtggctttggcaacctcgccgtccatagatgcaccaatttgaggttgaaattctactacagtaaccttggagcctaatctagagtaaactgaacccatttccaatccgatgattcctccaccaatgatggttaatcttttgggaatttcctttaacgaaagagcacctgttgaagagacaattttttcctcatctatttcaataccggggaagggtgtaacttcagagcccgtggcgactatgatgttcttaacatctagtatgtggtcttccttgacagtgccttccaacccatcaacgggagttactctgatcttcgtttcgtcttcgaatgaaccattacctttataataggtgaccttatttttcttgaacagaagctcaatacctccagttaattgcttaacagcgtcatccttagccttttggaagtttgctacgttaattttgatatcaccgttgacgtcaatacctctcttttgcgcttccgtatgcatttggtggaataaatgagaattatttagaagtgctttggaggggatacatccaacgttaagacaggtaccgcctaatttgcctcttttttctacacatgcagtgttaaatcccaattgagcagctttgatagcagccacgtaaccagcagggccaccaccgatgatgactacatcatgtgacttgttaatggtcaatgtcctgactgtggacgaaaaggcacgcttattatttaggagtgatctgattcttaacattgtgaactgttagtatgttctttgatggtacgacagagacaatcgaacaaaaccgtatatatataaatatacgttatatgtatatatatatctatatatattcgaggtgagtcaaagggtacgaattatcatcaaattgtttattagcattataatacactaagtttccattaagttgctccgcggagacttctcgccaatgagggaacagccgttcgagatgataaagtattctaaaaacgagtcatcattaaaaacgattcacgtgatattcacgtgcataaaccattagtaagtatatatttttagtgggatatatgagggtacattgcatcatgactattcgtggtagtcacgcatacgtttgtcagtggcattgttcgagtattcctctgttcttcatttcccttttttcctatagcctcgcctacgctctttcacgtttgtgctgatagaaacaatgtggtaagaaaaattaaatctctaaaggtgcaatgaatgtataagaaagtacaacgcatatagagtatccggcataggacaggattacgcaaacacacgcacagatacaatggtttctacccctgaactgaagaaatatatggacaagaagatattgctgaatataaatggatctaggaaagtggcaggaattttgcgaggctacgatattttcttaaacgtcgttcttgatgatgcaatggagataaatggtgaagaccctgccaataaccaccagctaggcttgcagaccgtcattaggggcaactccataatatccctagaggctctagatgccatataaaattatatatatatatatatatgtcgacctctatgtactatacagcaatactattttctaatttgcatttccacgcctgcgttgctaaacccacatttttcatagaatttgacatttttctcatcgcaatctaaaataatcttataacaaccgtagtcaaagccgatagttaccaattgatcaatcaagagcttgcccaaaccttggccctgatacttggagtttactgcaatgtcctcgatgtggccacatagccccagttcatgaatgatctttctttcgatgatgatattccccgtagcggcaaccgtctcggtgcgcttgtccacaatcaccatggggttatattgcattatttttttatcttcgttatcattccatactgtggcttcattccagtattttatgagtttgctgaaggattcgggggtaatagtgcccacggtggtcaaaacctttagcgtctcagtgacctgttccaaatccccctcttccattcgccttatataaaatccatcgggtaagctcattattttatgttgatatccagcttccgttcgtcaactattctctcgagctcagttttgggttttggcatgtaaacaatgccttcgcttgtattacgcaaaaaaaaaaaaaataaataaaaaaaaaaaaaaaaaaataaggtataaatcgttggttcttttatgcacaattatttaactatagttatctatttacgtaaaggcttctatttttccttatctacaagaaattgcatgaagtttaattttttttgtcacctttgatcttcctgaatgtgttggtaatgaaattttctagtctcttcaaagtgttgtcgtcatccttttttgcgtgtttttcctcttcttgtttttgtttcttcagtatctcttcattaatggctgtacccgcggctgtgcccggttgcatggttttcttggccatgtcatcgttggtgacatctgccagtgcctcccacaagcatttttctgccagcgattgcggtttcttaacaacgatcttgtactggactttcatatcaccgcgaatggttgatgttttaggaacacccatgttaggaatggatatcacttgattgtattgagtccctggagcgacctttatcctgatcttttgtccctccacagtggggatagtgacagtaccaccaagtgcagctgtggttataggaatctccttgtcgtaccaaatatcgtacttgttctttatcgaaaagttgggatccttgtcgacacgaattctcaccaaaatatcacctcttgataacttgactgaatctttcaagtccgcctctacagcgatgtcagggtatgagccttggccagggatcctgaccacgtcgccgtcctgtaatccatgtggcaagtccaccgtaattgtctttgccctgttgacctgaacaccctcaccatggcacttggtacaattgtcctgaggccgtttcatggtaccttcaccgttgcaagtaggacaagtcgacatcatctgaaatccgcccctaatgtgaacagtggttcctgttccgtgacaagtgctacaactgaccttatgcgtgtttggtttcattcccgtccctgaacaggtactacaagggtccagcgcagagaatcttaactgaacgttcttggacccaaacactgcgtccttgaaagacactttatggacaatctcgattgggtcgcccctatattgtctgaacatagatgacgacctgcttgcgccaccgctaccgcggccaccaccaccaaatgcagcaccaaacaggtcttcaaaattgataccgccaaatggcgagccgcctgcactggtgaatcctgagaaatcatgaaattgggaaccaaagggagagccactaccaccaccggcacctccagcggcaccgccgccgccgaaggcagcgggcccaaattgatcgtactgctgcctcttcgtttcgtctgacagaatttcataagcgttctgtaaatcgtggaatttcttctcagcatccggttccttgttgatatccgggtggtacttctttgccagtttgtagtatgcttttttgatttccgcacctgtagcagatttcttcaagcctaaagtatcgtacgggtccttgaatgcttcgttgtttctgattgcagaagtatggaagctagattttggtattcgtggagcgatggatgcaaacgcgatggcatgtctataaagaatattattgatatggcgagaatgtcccacatggtgtctaaagacaccggaacaccttgacaatacaccttgttggaaagccattgttatgttatgtttagagtatgatataggacttctctctctttttttttttttgtccaggtggagtgcgatttgttcgttatatgcctcattccttaatttttatcagtcagaacgttatttcgcgctgcaagttccttacttttccatagagttccacaggatgtaaagaaaaataatgataaaaaaaagcagaacatattacccttcttttggagcgtacttccatctgttacccgctcatccaaatgcacattctgttaccctcttgttcggtatttttcggagttctccttttctccttcttttcctcttgatacacagaaaagtgggagaaggtagggggagtcagagaatgaagaaaaaaaggggacgcgcaaatccaagtgaaaatctccgggagcgggcggatcccactaacggcccagccgaaaatggaaaaaaagggtcggtgatgtgtgggtgccagctggcggtagcaatgacgacgtgttgacgggcccttggctcttgggacaaggactagaagccaaaagccagaggcggtaaaaatagcaagactagaatattgctggcatctgttaaggggatatgttgcaacttgcagggggcggcacaaaataacatagaaacgtagtaaagaggggaaaaggaaaaggaaaaggaaaaggaaggaaaaaaacccattgacgtagaaattgaaagaaggaaaggtatacgcaagcattaatacaacccacaaacacagaccagaagcactctagacggagagtaactagatctacagcccctggaaaatcgtttggtcaactttgaggttccggtcgtccccctcttgatctgaaaggtctttctctaaatctatattaaaacgtataaataggacggtgaattgcgttctacttcctcaattgcgtttgatcttatttaatctctctctaatatatagaaaaaaaaaccatctgattattcgataatctcaaacaaacaactcaaaacaaaaaaaactaaatacaacaatgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaaatctttcggaactctttgtagttacatggttttttctttatgatgtgtgatgttccttaatattatattcaatgaatagcagagtaataaaaaaattctaaaaaaaaaacgcttaaatcgaggtggaatatataaacttaagtacgcatatactctagttcagtttaaaaattagctgtttttttaaaaaaaaaaattctctttctttacaaaatgttcttaaatgtatgtatgtgtgtgtgtgtgtgtgtgcgtattgttctatttcactccagcttaaacatggcggttgcttcttcgtcatcaatttccgcgcgttcgattttatttaaaagtactttctttgaagcgccgagatttttcatgaaatccgtctcaaatccaagcaaattatctttgaatttctttctctttttaccgcgaatcccaagcactgacgctacggggatgtcttcaaattcattgaatatcttgattaacccaatatcgcgtcttttcaacctgtttggcacctgggattttttcaaatcggcgagaaactcctcttgtgtcttaccattttctgacacatgcttgttcagatctagcgatattagcttgtcgaccttgtttaccgtagccgaactattgtattttttcaatggtgttagatttaaatcgtttttgtcaatgatagcagcggaggtgatttcttcttctgtttctgttggtgctgctggcgttactttgggcagttgtggtgtgacttttttcctgttcaatgtcatgggtgaagaagattccagtatgggcgtaggcgtcaaaagtgatctagtctcctctacagtctcctcgctcttgtcatcttccccttcaccgtcctcttcactcttgtcaccaccgatactgggctttttcacctctgtaacattggtacgctcgcgcttcctaccctcctccatcttactcatgaattctcttctcttgatgcgttggttggctccgaactctaattcatcttcaggatccgtgtcgtaactgcgttccgtacaccttaaaatgaactttccagcaggtgcaccatcttccaatccattgaaaaatcttactgattcttcgacctcctcctggcttaagtttgtctccaaatgaatatatagcagccaaatcaatatgtttgatctatcctttggctcgtatttcgaatagtccagtatatcaaataatgttgttgcataagctgcttttgattcttgtttttcattttccgcttccgtttcttttacttcattctgttcatctaccatatcttgctcctgagctttcgattcgacttccacatacttggaaagaaacctcttgtcaattaggccggaattatcacatatgctaaacaacatattaataatgttaaatttgttaacggtgtccacttcaccatcattttggtcgacctttttgtaagtctccatcaatgagagttgctcattgccccacggcagatttttcagaatagatttcagtctaggtgtatcctgcaaaagtttcggatcattggcatgtaattgtaaaactggcacggagtgaaaagttctcaattgcgatgtcatttctaaataaaaatttatagtggtgttcaacctaccaatgttgaccaataacgctaaaacacaagtagaaaatgctacttgttggtctaataatagtttatctctgagaattttggaacatttgatagaagtggctattgtcaacacatacaattgtgcgaacgtcaatttatcgttaaatacaaatgtccttgcatcgtactctttgtcggtcacgttgattgataatttatcgccatcgatattaatgggtacaatagagttcttgtataggggttttagaacattagtgaagatttgcctcttgtccatcaacagttcttgcatgaaactgaactgaatgtcctttctattgaatggctcgccgtcaggtttcttcaaatgacgattgtatttactggcattgctttctttgggtttccttctaacagtgttagttgtcactggccccgttgccgtacttgctcctgttgcttcaggcactgtagaaggttcgaagttgagcaagatgttggtattttcttcttcactttgcgtggagtcatcatcatttttatcgtcgatttcaatctcgtgtataactggaatgctttttgtagtcacagtctcggtctctgattgaatggagcttggggatgcttcttcttgtgatcccgattttacagattgcattggagaatctgcttttgtttcgtcagaattgtcttctcgtagttggaaagtatcatgaattggatcgtatactctcttccccatctttaattagagtgtcgcctttatttagctttcgattttacttagttaatcatgaactgtttccaataccatatcagcattcattgggcgttctttacttacttgtaccgttaccgcattcgagggtaacctgtttttcgttgtacacgatatgctacagaattgtcttaatatgggctaagaaaaaaaaaagtctgattatttctgatactgcaaaatatatactggcttggttaagaaaagtgttgctttagttcctttacatcaagagtcgttaaattgttttgtgtcataacagtagtggtcttttgagacatcaatcgactctcaggttttccttctgttcatcttcttgttttcggtaaaggtcagccagcatatttcaattctctcttttttgaaataacattatgtaatctttcaatcctttctatccaacgtctgctaaataatttattcaaatgacatgtagaccagaaaatcgaacgttggataatttttcatcctgaatcatgttggtctcaactagagcaattttttcacgtcctctgacacaaaactcgataaactgtcgcatcagtttaaaaaaatatgtacgtgtataataactgaatttaaaaggatagtaaataatttttgcattttatggaatgtcaaaatactaataagtcgcaaatatagctatcaaataccataatttagctacttatagaaagatgcccaaatcccgaccaaaaaggaccattgcgtcttcctcgtcagttttttatggaagttcacctttccaaaatgatggctacatcaaagtaatggaactcgtatcacacattgtcattgaaataaatcattcacctaccgcaacaacggatgaaacgagaaagcagaataatccggagctgaaagtgaaagaaccagtttgtaacctcaagaagtgggaaaataacactaactttatattggaagatcatacgaagaataaaacaaaactttctagcacagataggatacgtaagtggtttagaagacatatattaaaggaagagatcgaaatcctttcccatggaaaacaattgagtagtattgatgaggattattgcccttcaaatgttcttgtaggatgttcaagagatctaaataaactcagatcatttcaaaatttttaggaatataaaatttctcagtaagaaaaagaagatgaatgcgtttatagtattttaagttgttcaatagaatatcttcaatatgttcatatgtggactaaaagaagattttggtatatgtctataaatttattgttggtaaacgccattaagcagctttccaagaatatgttatcattgaggagaagtacgaaaactgattatgcacgattaggaaaaattctgcaaggagtattaaaaaatggccttcgagaagaaatgaaatctctttcgatgagcaatggtcttatggataatttgatagacatatgaaaaagtcaaaagtttttttggccatatgcagtaaaaacttacccttcaaattgcaaaaccattagttttattatatttttttttttttctttcattgaagtatacacgaaatcccatacgcaaataaacagtcgttgtatcatcaatttcggctgtctggatggcgactacgagaggaagcttgcttgccatgataggaccaatctcaatttttaatttttcattaactagctaattttctataatgctctaagtttcctttttcgttttgtttctttatagtgatgatgctgttattgtgacgctatcaaatcatatactgtcatcaatcctcatctcatcggctccggaacgcgttgaatatgttgttaaacaagctctttatagctagctatagtagaaaaggaaggaaagaagtctaatcgctgtattatcgactgacaagggttgtcagttgccttcttttattttttgtactcccctgaatcgagcggatgtattttttaacaaagtattcagaattgtttttgtataatcaaaatttgtcgacgctaagaaaatgacggacgtcgtaattccgctactaggttttgtgtgctcatcgatatttgacacctattttcgacacttttaaggttatatactttgtttcggatgtggggtacactcagttgactgattatgaaagatatggcgtagccgttgggttagggttattacacagaaatgaattataccagtgaaattattctctttatgtttgttcctacatgttttccaatcagaaggaattgttatataaggacacaagaaatgtgttggtacgctctgcgcctcaatgacggtttatctatctaaaactatttctttctcgtaataaaaatacaataaataattaataataatatagttgatcgatataacaaaaaaataacagcgaggatggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataatttctaaatattcttgtactctggtaaacagaaataacaacagataatggattgatgctttacttctatttcatggagattggttttatataatagcctttattaatggcgtcacaaattgaaaaaaaaattaaaaaaaataagacggacacatttgcgacgccggtgaataaatgcatataagtagtttataagctagctactactcagaaataatttcaaaaaaaaaaagaagtgggcactttaaaatgaagattagctatagtaaattactgtagtataacaactacctgctatctttctgaaaaaatcaggcaatgtaaggtcaaacttgtaccatcgacatatataatgttttgagatataagtaactagagaccagtttatacaggatcttacctctttttaccgttatgaaagctttattactgcgttgttagtaaacacacatattattttcgggtagtcctgtcgatgttccaaggctttgcatttatcattgtttccgcttcatcggtggtattagttagtgtatctgtatgtgaagtatgtggataggtgcttctattattggaacaaaacaccttaaacgcgcactaggttataggaaagggtccattattcaaagaacggcttattgaaaagtatgttgtaaagctcggtcatatcgcgcatagccacgataaggcgtggtgctgcttcatagattgagaggcgcagtcaatacacaaccataccggtagtttgataaatgatactatcattccggaagctctctagtaagctgtaggtggcatatacggtatctatcatctagtaatagctattgatttttttctcgactatgctatatgtgttgtgatggttcacttagaagtgaaaaagtagcaataaattagacagacagaagtaattgaagctacattcaacaacatggctaagtaaaaaagcgtagaatatcatgatgggtttttttatcttttaattgctttctatgtagtataatggaccgatctttgcaagtatatatctgtatgtatccatatttagatggcagcaagcaatatagatttgatgagcttatatcattttatcgtccttgtccaaaaagtcttgataacattaaaagtcactaccgtcaaatccatcatcaaatccgccgtcgaacccaccagcatcatcaaatccgccgtcggacccaccagcatcatcaccgtagtaattgttctcgacaacgacagtgtctggtccgtcatagttgtggtcgtcaaatgcgtgttctagcatagctccacctaacaaacccgcaccaacaccaagtaaaccacccatcatggcaccgccgtgtccactacctttactggtgcttggcgcagttccatagtatgcttgctgtggtgctgctgctggcataggggcttgttgaggatagtaacgctgctgttgagggtattgagggtactgaggctgttgaggctgatagtaacgaggttgctgtgcttgggcccctgcttgcacttgcggtgttgattgagaagaataaggtggaggagcctggtctgcctgttgacgagaactcttctcattgttaacacctggtggaggacctttgggtcttggccatgttgttccccttggtggttcccactgagagctgttcgtagataaatctacataataccaagtctggtattcatcatcaaaaacagccttccagccagaaggcacttgaggaggattacttttactttgagccattactttaaaatgttttgggtttttttatcgactctcttgtagtgagtgataaaagcaattcagaaagagtcttttgattatcatgactaaagtaaactttttcttccagctgccggctcggtcaggtggacgaaacaaaaaagcctgttgaaataatactgaatacgttaaaacgtcacagcgcttgtatatcttgtgagagaaaggctattaccactgttatatgaatatagattgctcaacaaagcgtgtctttttctgtgtgcttaaaatatagtgtcttttttgggaaaaaaacgtttatttacagtattctcttcttcttctcctcattcaacttgttgcggttcgaagaaaattacgcataaagaatcaaagaaaggcaaaaattacgctgtacgatggggtcgtttcccttagctgagtttccattacgtgatatccctgttccttatagctaccgtgtgtctggcggtatagcttcctcaggtagtgttactgcgcttgttactgccgctggcactcatcgaaactcgtccacggctaagacagttgagacagaagacggcgaagaagatatcgatgagtatcagaggaaaagagcagctggttctggcgaatccactcctgaacgcagtgatttcaaaagggtaaaacatgataatcacaaaaccctccatccagttaacttacagaacaccggtgcagcgtctgtggataatgacggtctgcacaatttaacagatatatccaacgatgcagaaaaacttttgatgtctgtggatgatggttctgccgcaccttctacattgagtgtaaacatgggagtggcatctcataatgttgctgctcccactaccgtcaatgcggcaacaataactggcagtgatgttagtaacaatgttaatagtgctactattaacaatcctatggaggaaggagcgctgccgttatcacccactgcttcctctccaggtaccacaactcctttagctaaaactacgaaaactatcaacaacaataataatatcgccgatttgatagaatccaaagattctataatctcccctgaatacctttctgatgagattttcagcgcaataaacaataatctccctcacgcatacttcaaaaatttattatttagattagttgccaacatggataggagtgaactatccgacttggggactttaatcaaggataatttaaagagggacctaataacgtctttgccttttgaaataagtttgaaaattttcaattatttgcaattcgaggatattataaattcccttggggtctcccaaaattggaacaaaataattagaaaatctacatcgttgtggaaaaaacttctgatatcggaaaattttgtgagcccaaagggttttaattctctcaatctcaaactctcccaaaaatacccaaaactctcacaacaagatcgccttagattatcttttctggagaatatattcattttaaaaaattggtacaatcccaagtttgtaccacaaaggaccacgttaagaggccatatgacgagtgttattacgtgcttgcaatttgaagataattatgtcattacgggggctgatgacaaaatgatcagagtttatgattcgataaacaagaaatttcttctacaactatcaggtcatgatggtggggtttgggcattgaagtatgcccatggcggtattttagtcagcggttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatatggcatctgtaagaactgtctcaggccacggtaatattgtcgttagtggctcctatgataatacactgattgtgtgggatgttgcgcaaatgaaatgtttgtatattttaagtggacatacggatcgtatttattcgacaatctacgatcatgaaagaaaaaggtgcatctctgccagtatggataccactattagaatttgggatttggaaaatatatggaataatggagaatgttcctacgcaacaaattcagcatcgccatgcgccaaaatacttggtgctatgtacactttgcagggtcatacagctttggtcggtttattaagattatccgacaaatttttggtcagtgccgctgcagacggttcaataaggggttgggacgcaaacgactactctagaaaattttcctaccatcataccaatttgagtgcaattaccacattttatgtatcggataatattttggtgagtggatcggaaaatcagttcaacatctataatctacggagtgggaaattggtccacgcaaatattctaaaagatgctgatcagatttggtcggttaattttaagggcaaaacacttgttgcagcagttgaaaaagatggacagagctttttagaaattctggatttcagcaaagcttcaaaaattaactacgttagcaatcccgtaaactcctcgtcgtcgtctttggaatccatttctacttctttgggtctaacgaggacaactataataccatgacctttcccagagaataagcattgactcatacttagataatatagcttaataagtagttatataatcagtaaaaaagtacaataacaacttcgtacattttattgagtataaactgcagctaaactgcctggatgtgtcaattttaattgtgtttacaaaaagggtgccgtttattaattaatgtttcttccctgaaaatatggaaagtacaagtttttagttgagaagggtttaagaaagttttgaaaatgatctaaaaaaatataaaagcaatcaaagaaataaaagctggaaaaatgcgtaataaccgaagtgactaaaatttctttacgcgccaaataagaaatcgatgctcttgaaagtagcaaccattttttaaataatatattcctgatggttcttggcccaagagttttcttgaacttttaacgttaagaagttgattctgctgatttttttcaagttatcaagcgttatgttttgaaacatctgttccgttttcagtttttcaaaaagatcgatattctcttgagaattaggaagttctacgctcaacctcccgtgggcagaagaaatacaaaagctaatacaattgtgttagaataaagttctaatattatctaattagtagtattcatgttactagtatattatcacatgatatttctcaaattggacaatgtaaataatgagtgtttttatgacacaatctttatcgttagatgtttcaacgttccaaggcttggttctatcgctcttctcttcaaattgtaatcgtttgtcatgataaacacgtacgggaaaaaaaaaaaaagtatcaataacgcgtaaagtgaatagagtattggattctataagaccgaagacgctcatatcacatctcataaaatcacttaaagcaagcatccagaggctattgataaaaagcaggcacaaggagacgcaatgggacgtttagttggcttagaactaagtaatttcaagtcctatagaggcgttaccaaggtaggattcggcgagtcgaatttcacaagtattatcggtcctaacggatctggtaaatcgaatatgatggatgctatctcattcgtactcggtgtgcggagtaatcatttgaggtcaaacatcttgaaagatttaatctatagaggtgttctaaacgatgagaatagtgacgattatgataacgagggcgctgcctcttcgaacccacaatccgcatacgtgaaggcattttatcaaaaaggtaacaaactggtggagctgatgaggataatttccagaaacggtgacactagttataaaattgatggaaaaactgtctcctataaggactattctatatttcttgagaacgaaaatattcttatcaaagccaaaaattttctagtgttccagggtgatgttgagcaaattgcagcacaatctcccgtagaattatcaagaatgtttgaagaagtatcaggttctatccaatacaaaaaggagtatgaagagttgaaggaaaagattgagaaattaagcaaatctgcaaccgaatctataaaaaataggagaaggatccatggagaattgaagacatataaagaaggtatcaataagaacgaggagtataggaaacaattggacaaaaaaaatgaattacagaagttccaggctctatggcagttatatcatttagagcaacaaaaagaggagctaacggacaagctgtccgcattaaactctgaaatatcgtctttaaagggaaaaataaataacgagatgaaatcattacaacgctcaaaatcttcctttgttaaagaaagcgcagtaatttctaagcaaaaaagtaaattagattatatcttcaaggataaggaaaaattagtctcggatttacggctcataaaggttcctcaacaggcagcagggaagcgaatttcccatatagaaaaaagaatcgaaagtttacagaaagatcttcaaagacagaagacttatgtggagagatttgaaacacaactaaaagtggtgaccagatcaaaggaagcttttgaagaggaaatcaaacaatctgctagaaactatgacaaattcaagctaaatgaaaatgatttaaagacatataattgcttacatgaaaaatatctgactgaaggtgggtcaatcctagaagaaaaaattgccgttttgaacaacgataagcgagaaatccaagaggaattggagagattcaacaaaagggcagatatttctaaaagaaggataacggaggagctttctataacaggagaaaaattggacacgcaattaaacgatttaagagtttctttgaatgagaaaaacgcccttcatactgaacgtttgcacgagctgaaaaaattacaatctgatattgaatctgctaataatcaagaatacgacttaaatttcaagttgagggaaacgttggttaagatcgatgacttgagtgctaatcaaagagaaacaatgaaagaaagaaaactaagagaaaatatagcaatgttgaaaagattcttccccggagtaaaaggtcttgttcatgatctttgtcacccaaaaaaggagaaatatggcttggcagtgtctaccatcttaggtaagaactttgattccgtcattgtagaaaatttaaccgtagctcaagaatgcattgcatttttgaagaagcaacgtgcgggcactgcatctttcataccactagacacaattgagacagagttacctacattatcattgcctgactcacaagactatattttatcaattaatgctattgactacgagccggaatatgaaaaagcgatgcaatatgtgtgtggcgattccatcatatgtaatacgttgaatattgctaaagatctgaaatggaaaaagggcataagaggcaaattggttacaattgaaggtgctttgatccacaaggccggtttgatgacaggtggtatatcaggagatgccaataataggtgggataaagaagaatatcaaagcttaatgtctttaaaagacaaattactaatccaaatcgatgaactttccaacggtcaacgctctaattcaatcagagcaagagaagttgaaaatagtgtttcactattgaactcggacatagcaaatttgagaactcaagtaacacaacaaaaacgctccttggatgaaaatcgtttagagattaagtaccataatgacttgatagagaaagaaattcaaccgaagataactgaactaaagaagaagctagatgatttagaaaatactaaagataatttagtgaaagagaaggaggctttacaaaataatattttcaaagaattcactagtaaaattggctttacaatcaaagaatatgaaaatcattccggtgaattgatgagacaacaatctaaagaattacagcagttacaaaaacaaattttgaccgttgaaaataagttgcagtttgagacagacagactaagtactactcaaagaagatatgaaaaggcgcaaaaggatttagagaatgctcaagttgaaatgaagtctttggaagaacaggaatatgcaatagaaatgaaaatcggatcaatagagtctaaattggaagaacacaaaaatcacttagatgagttacagaagaaatttgtaacgaagcaaagtgaattaaattccagcgaagatattctagaggacatgaacagcaacttacaagtcttaaaaagggaaagagacggtataaaggaagatattgaaaagtttgatttagagagagtaacagcgttaaagaattgtaaaatttctaatataaatatacctatatcatctgaaacaacgatagatgatttaccaatatcttccactgataatgaagcaattacaatttccaacagtatcgatataaactataaaggactacctaaaaaatacaaagaaaacaataccgattcggcaaggaaggagctggagcagaagattcatgaagtggaggaaatattgaacgagttgcagcccaatgcaagagctttggagagatacgacgaggcggaaggaaggtttgaagtgattaataacgaaacagaacaactaaaggccgaagaaaagaaaatattaaaccagttcctaaaaattaagaaaaaaagaaaggaactgttcgaaaagacatttgattatgtgagcgaccatttagacgcaatctacagggaacttactaaaaatcccaactccaatgtggaattggccggtggtaacgcttctttaaccatagaagacgaagatgaaccgttcaatgcgggaatcaaatatcatgccactccgcctcttaaaagattcaaagacatggaatatctttctggtggtgaaaaaaccgtagctgcattagctctattatttgctattaattcctaccagcctagtcccttcttcgtgctggacgaagtggacgcagccctagacattactaacgtccagagaattgctgcctatataagaaggcaccgtaatccagatctccaattcattgtcatttcattgaagaacaccatgtttgaaaaatctgacgctctcgttggggtttacagacagcaacaagaaaactcgtcgaagatcataactttggacttgagcaattacgcagaataatctatgaaaccaacctctgctataacccgtcaaataactaataatatctatataggtcaactagctagtgcaatatcatagtaacaataatattaataacgtcactttttttccagggtaacccaattgtggtgggtggcggccgaggtatcccttagaaaagaattttttaagttctttctcatctcttaccagtggagaagtacacgatatttgcaaagtctgtcatcagggcttgataataaagctgcattagatcttagcaaaaactacgagaagaacattgaatattgtagctgtatttgcatacataaactttatcattgttcgttagctagctttgcacattaatttttcgatttgttaccgccaatgaccgctaacaatgacgatgatatcaaatcacccattcccattactaacaagaccttatcccaattgaagcgctttgagagaagtccaggaaggcccagttcttctcagggcgagataaaacgtaaaaagtctaggctatatgccgcagacggaagaccacattctccgctaagagcaaggtctgctaccccaacgctacaggaccaaaaactgttcaatggcatggattccacttcccttttgaatgaaaggctacagcattatacgctggattatgttagtgacagggcccagcatatgaagaatatatatgacccatcatctcgctggttcagcagatccgtgaggcctgaatttcctattgaagagttcttaccatataagactgaaagtcatgaagatcaagcgaaatacttgtgccatgtcttagttaatctttatattgcgatcagctcattagatatacaaggtttgatttctatttccagtaaagatctggctgatttaaagaaagaagtggatgatttagctcttaaaaccgatcttttcaggttatctaacaacacagcggagaatgacttacttggtaacgatattgctgattatgacgatgcggaaggcctggaggacgaattggatgaatacttcgacttagcaggccccgactttaatgctaccggaaaaatcacagctaaatcagctactattgtgaatgtaaaccattggactaatgagctcaaaaattgtctacattttgattttccagtagctttaagaaagtcgctagcgacagtttattattatttgtctcttgttcagggccaaaaggtgtatagacaaatgcatgtcgatatgttcgaaagattagtaagccttgacgatgataggacaaatttcactgaactgttgcaaaaacaaggtcttttgctagatcatcaaatcatgctcaatttcctgtgcgaatttctaccttatccagatcccgactatgctcgttatgaattatcatcaaaggaagatttacagttatttagattacttttgaagcatgcacataatgcaaaaccatttttcgataagtcaaaggaaagtttgttagttgatacgatgaattttctgttgtctagtcttgcaccatctactatgatggctgtcatgcctatcgttacatccgttgtgccctatcattatcatatccattctaagatcatcgattatttcccgttttgctatagcatctggagctcagtcagcgcaaacgtggccatcgacactcacatgtatgattttgttgggtcaatttccaaagacgttcataataagattttgagtagcgagcatgaaaaggatgtagttggagtggagtttggagaattcgggatttttactgatgatcaaatgacttttatgttcaataggttacaaggccatcttagaacagacggtcaaatacattcgtattcccgcacagtgaagccttttgtttatgctataaacggatcaaaaaaagataggttttttgaaaaacttgtaagtttagccaaagcaatcgaaacatttatccatccctctaataatgggttttggaccaagccaaatgctaaattcgttcatgcatttataaagtcttaccacggaagggtcaaatatgaagaagatatttgtgctaggggcgtcacaaatgggatatgtttaacttctttttgtcacgaagagatagttgaaatattcttaaatattatcagtctgggttcacagaataaaaatcctgatattgcgaactattacatctcttgtttcgcatatctgttagagctggatccttcaaatgcatatttaatttatgacaaaatactgatagatttgtacgatacgctggctgaccaatttatcaattcgagacacagaatcatttcctctttgaaacaatttacaagagtaattcggtttattgtgatggataagctatatcgcgtgcacataacaaacgtcctttcgatgctggtctccaaacttgatatgaacgatactaatttgacaagcaacctcatcaacggtattgtatctatagccgctttcattcctatccaagacctcactggggaggacgattatatatcgtttgaatcggatactcttcctttagttcaacaacatttttatcatattaagtgtggcgaaagttcaaagaccttccgagttgatgatgaactgttaaataacgctttcaaagcttccactacagtttttcaaagtatgctaaaagtatacgtagaaaaaattttccaattggttgatgtagacttagaggactctttggttactaaaataaaccaaacaactatgattttacaagagtctatggacgataaaatatttaattattttgcttctttattacagagaaacttctggagtaatgactccttcaaggaaaaggatccaaactatgaattagttactatcccactagcggctttagtaagaaggaataatggtttgagtaaagagttggtcagaactcttttattccatatcaaagaacaaatcaaaagaggcgccgggtctgtaagaagtacttcagagattcaacagagggatgttaagttagttttatacttaactgcactaaatgatgtcttaaggcaatgtcatgaatctctattggagtatagcgatgagttgataacattcatgaaatatttatacgacaacgtcactaacccgccattggatgttatcacatctattgttattcacagtgctttagcaactctatgtacaaccgaaataactgattgtcgtctattcccagaggactctaagattccggaaaaagacagatggggaggactacagttcgatcctcgaagatttgataaacagcatttgagttttcagtggcacgtaccttctagtgacgagataactttatccataagcattctagaaagcctttccgaatactgtattaacaacgtagaagaactgatgaaagctccaagacatgattccgaatatggcgatatgatacaaaaatatgttttagttatgacacatacgctttccgggtcaagtttactttttgatccagattttaacaaatataggacgcaatcaaacttatcatacagagagaaactgattttattaaagaatatacgcgaaaataattgtgaccctcaagaactggatattgatattgaacaaattcgttctggcaaggatgatgaagactatattgagagtaaggacattgaagcagggctgaatgcaggagtttccgatgttgtgcagttaagagatgagtttccggatgaattaattgttgatgaagaagtagtgtctgagatgccatctggtgtaaatacccctatcgcggggacgcatggcacggacaattcagctatgagttcggatctagctttcagggatttagatatttacacctgtaattattacttcggaaataccactgaggagaagttacaaaacccacaatatttacaagtccacagagttagagcgcgcattggacatttctttcacaaactctatgtttttttatctacaaacttcgaaaacaacaccaacatgttccaaattctattgcacggattgaaagtttggttcacagatctgggacaagaaacggtcttcaatgaagacccaaatgccttcattgacgttgatttcctagaaaacgttcaatctctctcacacgtaaatgagcccttcacgagaaccaattttgcaatcagagcaaacagtttgcaccagagtagagttctattacattcaacaaatagaaaagcttccaagctggaaaacctattgttagttgacatcatacagttagcgacatccctttatcctgatatttataaaccagcacagggaactttggtacactgtatgaaacaattagttgggtcatatggcgtagtcatcaataaaattattccatcattagagaaagcgattaaggatcatgattatatgaaaatccaagttattttaaatgttttgttaattaagaaaatccataggaagcttatgacggattataaagacatcggcagattgatatttctgcttattgaatgttgtcgtgtgaatgaattagagattggtatgtatgcagataaaatcttaactgacatagtgattgggatcaagattccttctagtgtatgtgtcatttccgatcaagctttcttacctttagcacctcctgatggtactattaatttgcaagttgaagcggtaaagcttgccaaaaagaaaaagcgtgagtactacctctctctgttagtggatttgcaggacaaacttttagacaaattagataatgaaaaagatatggggtggaagataagaatgttcattttacgttttgttacacaaatccaatcgaacctcgaaagcaaacccgataaaagagcagtattttcaataatctcccaaatctccacaaaacatcccgaaatcatacatttggttgtaaagtcattgttgtcgacgtgcaacaagataatatctctctctgactatgaatatgacatcaccagggcctataagaatgaattcaatccatcatttgtggaaatactggacacttcgaccacaagcttccctaaaacgtttactgaagaaatgaataactttgataaccccaagtattttatcgatttgagggcgtatgtagggtggctatgttggggaaggcttatgtacgtcatgtcgccgaaagctttaaagctcaatttacgtgagaatgaactggaagtcctcaagacagctggtcatctattgacaagagaattcctgagagatgttacaatgaatttagtccaagataatgaaactaggggtgtttttagtagtggtaacgtgtcatttttctctttagtaatccttttgatatcatctggtttctgcgaactgaatatgtcggatctctttgagctatgtgaatcctactataacaaagacgataaggcttcgatgatcatgtctgtcgagatagtggctggcttagtttgcgggagtaagtttatgtcagtctctgacttggacaaacgtgacacttttatcgaaaacttcctagccaaatgtttagattatgagttgaaccatgacgcatttgaaatttggagcaccttggcatggtggttgcctgcagtcgttgatttaagaaggtctaaaacttttttttgccattttatcaacgccgatggcatgtttgaccgtgaatctgatgcagccacacatcaaacctccaaaatttacatgctaagaagtatcttgatgagcatggaatttagagccccagatgttggtaagctatttgatgagttggtatttgatcacccatacgatcaggttcgccagctgtcgctaaactattgacgaccttagttcaaaatcaaagtaatccgtcaatttcagatccaaccacattattagaagcagaacggaatgatccagatggattagggttaccattaaaaagcgtcccagaaaaggtggatgcctatattaagaagcagtttgagatcattaaaaatctggaagattccgttgtcggcctgaatcctcaacaatttattaagacagactatttttacaggacatccacaatattttattggatcaaagaaatggcgagagggcctaataaagttttgttagttccatatttagtcgattatgttttaccatttctgatcggattagtgaaacataaagatgtttgtgctcttgccagtttagatcctgttcgattgtatgccggcttgggctatatgccgatcagaaagaaccatgttgccgccattgttgactatgtttgttcgtcaaatgtagcactatcttcaaaccaaacgaaactacagctagctttcatccaacactttttatcagcggaactgcttcaacttactgaggaagaaaagaacaaaattttggaatttgttgtcagcaatttgtataacgaacagtttgtagaggtgagagttcgtgcggcatccattttgtctgatatcgtccataactggaaagaggaacagccgttgttgagtttaatcgagagatttgcaaagggtctcgacgtcaacaaatacacgtcgaaagaaagacaaaagttatccaaaacggatatcaagattcatggtaacgttttgggtttgggagctattatatcagcgttcccctatgtttttcccctaccgccatggatacccaagcaactaagcaacttatcctcgtgggccaggactagtggtatgactggacaagctgccaaaaatactattagtgagttcaagaaggtgagggccgacacttggaagttcgatagagcatctttcaatacggaggaactggaagacctggagggtgtcctatggagaagttactatgcctgattcatattagtataggatattaagcacatatctagacatatatgtacatctaaacaaatagctggagctatctgctgattagttttactctaaaagtaagttgttagtgtaactatgatcacggctgcgtgccgggtaataaatcaattttgaggaaaactggaagttcaccactgagaatgatcaacggcagggaaacgttataccaaacaaagcattctacctctagggaagctggaaacttgaattacccactatagcttgtcttttagtgatccattattccaacctattgcaattccaagaaaataaactaggaacttttttttttggaagaataagaaaaggagaaaaagtagacatactgtatatacacgagggcgtatcgttcaccagaaagaatataaacataacaagataaacatgtcaggcttgagaactgtttctgcttcatccggtaatggaaagagctatgactctattatgaaaattttattgattggtgattctggtgttgggaaatcatgtttattggttcgttttgttgaagacaaatttaacccgtcatttatcaccaccattggtattgatttcaaaataaagactgtcgatatcaacggtaagaaggtaaagctgcaactttgggataccgctggtcaagaacgtttccggacaatcaccacagcgtattatcgtggtgctatgggtatcattcttgtatatgatgtgacagacgagagaacatttactaatatcaagcaatggtttaaaaccgttaatgagcatgcgaacgatgaagcacagctactgttggttggtaacaagagcgatatggagacgagagtggtaacagctgatcaaggtgaagccttggctaaggagctgggtataccattcatcgagtccagtgctaagaacgatgacaatgtcaacgagatttttttcaccttggcgaagttaatccaagaaaaaatcgacagtaacaagcttgttggcgtcggtaacggtaaagagggcaatattagcatcaatagtgggagcggaaacagttctaaatcaaattgctgttgaagaaaagaagatttttgcttctttgagaattaatcgtgaactggaattagagctataaatcgcttgattcttttttccctttttctcaatattcgcaggttatttttcctttatatatatacattgtttgtatctttttttgattaccatacttactatttttatattagtcatattagatgtcacttttatattatctaaacaattcaaacttctcacactaactttttcagcatacttctactgttgttctctgctctggaaggtattttcatcaggcgattggtaaaaaatcaagaaagaatctaaaaaatagtgcaacaggaaaacgaggttcccagtttccctgggaattcttatccaagtatatattttacttttaagattcagcacttttatttcgttctaatgtttttaccggtagtaaagttttgcttcttgaatccactattcaactacttgcgcttatgtaaggttcctgtatggttgcataatcactcaattcgaaaaaaaaacccacgtgctgcttggaaatgaatccgcactgcggtatagcacttccagaaagatactgactgcgaaattcgctttatggagtgtttaagcaattggtatcttacccattaagagtcatttctttcttcttgccaacttttttccatcctattatgacctcaaaaaaggcaggctctcttcgtcttatcttttctatcggaagcgaattactgggaaagaggcataggtataaacagataaaatagacgaaaagagtttagaaaaaaaagtagaaagaacgactacacctcaacataacgacacttttttgacatgctgtttggagtgaagttggctaatgaggtttatcctccttggaagggttcttatattaattatgagggcttgaaaaaattcctgaaggaagatagcgtgaaggatggaagtaacgataagaaagcacgctgggacgattcagatgaatccaagtttgtggaagagttggataaggaacttgaaaaagtctatggttttcaactaaaaaagtacaataacttgatggagagattgtcccatctggagaaacaaacagatacggaagcagccataaaggccttggacgctgatgcattccaacgtgtattggaggaactgttaagcgagtctaccgaattagacaattttaagagattgaactttactgggtttgctaagattgttaagaaacatgacaagctatatccaaagtatccatctgttaaatctttgttggaagttagattaaaggaattgccttcccattcggaagaatattccccattgttgtatcgtatttcatttttgtacaacattttgagaagtaattttaacactgcatctgaacccttagccagcgcttctaagttttctagcattgtcagcaatgacatagacatgaatttcagaagctttaaattttgggttcataatgacaacttaatggaggtcaaaacaagaatcttgagacatcttcccgtgttggtctacgccaatgttccctccgaaaacgatgacctggtcaatagattcgaatcagatatatcaaataatgatgaaattgtgggtagttcgagctccactagtagcgtagaacatggcttgggagcgcgctccttcgatccattaatcaacacgctatattttgacaatgagcattttgaattatataacgacaagttattaaagttaaattcagcacctactttaagattaaggtggactggccagttatctgataagccggatattttcttggaaaagaaaactcttattgaagacgaagccactgggaagtctgaatttgatctaactaaattgcaattgaaacaaaaattcattaacgggtttattttcgaaggtgataagaaatttaaagaacaaactttgaaaaagttaaaagaaagtggtacggcagggagagacctggaaaggttagaagaagatttctctgagattcaaaactttattatcaagaatgaattgcaaccagtttttagaactgtttacaccagaactgctttccagattcccggcgatgacaagataagagtaaccattgactctaatattgtattcatcaaggaggattcattcgacagagagcgtccaattagagaccctaatacctggcatagaactgatattgatgccaatgttgcaaatcccttgaaattcctgagaggaggcgagtatgctaagtttccttattcagtaatggaaattaaagtgaaaagttcattagattcttcgatgtctgccagttctatgatttctaatgtaaaactgcctaaaaagcatggtcaatggctgaacgatttgacaaattctcatttggtcaaagaaattccaaagttttctatctttgtgcaaggtgtggcatcattgtatggagatgatgaaaaattagatatcttaccattttggttaccagatttggaaacagatattagacaggatcctaagcaagcatatgaggaggaaaagaaaaaactgttgaaacaaaaagagatacaaaagaaaattgatggaatgagaaggctttccaacttaaaagagcctcaacatcaagcagcagtaccggtatctcaagaggaaaatgagcgtattacctctcaaggtgatttggaggcagacggttcatccgatgaggaaactgagcaagaacctcattcgaaaagatcaaagaaagttcggagaagaaaacccaaggccactttcttgagaattttggccggtagagatccaaagttaatgggggtggattctgaagaagaagaaattgaattgccacctggtgtgaaaaaaccattaaatttgttaaaaaatgctggtcctgtaaacgtggaggcaaaggtttggcttgccaacgaacgtacatttaacagatggttaagtgtcaccagtttattgagtgttttgacgttctcaatttataattctgtgaagaaagccgaataccccactttggctaactacatggcatacgtatattttggtctaacgatattctgtgctttatggtcctattccatttatatgaaaagagttgatattattcaacaaagaagcggtcaacatctagatgcaccacttggtccagttttggtttctatagttttatttgtcactttagtggttaattttgttatggcgtttagaaatgcagcaaagtctcgtcaagagttgcaaatacagaatttagaagttcctgaaagaataccagaagtattaaggccacttcaaaattatctattcaagttaatggggccaagcagtgattagaatatgtactctatctactgagaccatgtgtttttatgtttgtaatgtgtagcaaaaaattatcatctgctaacaattgcttacttttagaaatcacatttaaggggaagttttaaatcattcataaatatcaatgcatttacataaacatcattttctccggtttttgataactctgtacagaaataatggattatagttttaagctaagcggaaaagccaaattattcttcaaaattttcgatgaagtcggagtttatttcttttaatttccctaaagtcaagggctctttttcatttcctgcacattctttcaatatcgctacaagattgtgtattctcttcatttggtttatggtcttttgatcaacaacgccatttgaatcttcgttttcagtccttgcttttgcaattttcaaaagcgaatggatattgtacgcttctgcaataatatccgggttgaatattttttttaccacccttattccactattctctattgcgacagatttctgggtcaactgataattcattttgacagaattgtcattgagaaggactgcatccatatgaagatgggaaactgctggcttcttagacattattttaggaatgtcctggaagtgtgtagaaagaaataccgttgcctccgttcgaagtaaatgttcagttactgccaaagacacacaaaacccatcagcgatgcttgaaccacgaccaagttcatctaaaattaacagtgtttctgtatttatgtcatctaaaaagtaagccatttctttcatttcaaaaccaaaatttgatgaggttaattccatactgtcattgcagactcttgcatgtagacgtttaaagacaggaaaagacccataaagtgccggtatacctgatcccatttgggccattatgcaaataagggcaacttgttttaaataaacagattttccactcatgttgcatccggttatgatttgtaagctggagctatgttttgtacttgatatggtgttagggacaaaattttttagtaccttttcaagtagtgggtgtcttgaatctcgaattagtagattgtttgtaaaaatcggtattgtgtaattattttctttcaaattatatgtgaatgaacaaaccaaatccaggatagccactgcttctgcaatcataaatagttcagaaatatgggttgcaattttatcgagcagttcatcaactgtctcttcacttaaaagtaaaatctcttccataacttccttcaacctcgcatttttttttattatatttagggttgtacattcaatataatttttttttattgttcttgaaatgaatacgtctggaagtgtagcgacgtcatcggtaaattcctgtctttttattctgagataaaagcctcgtgcagaatcgtaattatgatctaaattgattttgtttttagcggtaagatcttctacctcacgaaaaaattcctcttttacctctttgtagatttgtctagaaacatccaaaagcccattggaatcacttttcacagcatatgaacgttggttaagtagttgtatagctgaggatgcccagacacagtcttcatttatacaactattaattaatttttcaatttccataattgcgtcattattgaatatttttttggtctcgctaattaaacggctttgaattaactgatcattaagtgcgtctttcaatgacttcacgctttgtaaagtttcctttagcaacaaaacgtaattaattctttggtcaggttttattgcagaatgattaatgcataataaccttgaaaataacttatctagatcaggcaatgatttcatttctagccttaatttttgtagaaggtcatcattggctttcaattcttctagggcctctagtctcatttcgatactgcccctatcagttaatggctgcagtatactgttccgaagtgatctttgtcccattttagtggacgtggtatccaagaacttccatagtgatatgccattcttatccaatttattttctacaagttctaaacctctgacggttttagaatcaatcagcattgtattttctgttccttcaaactgtatacgtagttttcgaaacgcattcaaatttcggctgcttttggatataatctcttccatgtagcttatcgcagcagatgcagcacaaagagcaaacgttttatctataatctcctcgattttcaagtccttttttgtatcatccattaaatactttgtaatcgccgccagtccatcttggctattgaagcactttcgtgaaccctcttcaattttaactgtctcggccacattaaattttatcattgtcgctaattttgatactgttggagctagagaactgcttggaatcagtatttccgtaggttggtaaatttggagtttatgaactacacgaatgtaaatttgtgaatccatgaaatctgaaagatacatctgtcccgtgttacagttgataatacataacccaatccgcgtacttatgtctcttggcacttcgtatatgcaacaaagaacacagtcaatactaggaccgaggagtgaagcgttggtgctgtatcgacttaaggaggttgcggtcctagaggccattgatccagtcattaagtaatggctatgtgttgaatctttttcattgttttcccatgttgtctctgctatttgtagcgttttctttttgagagcccaactacttatgttagttggcgatttttggttcctgatactctttttcgtacttggcttcgaaatagagtttgaagaattagccgccgaccttaaattgaaataatttgtactgataaaactagatagattagattcactcattgcatatagtttgcgttgatcagctacagatttcaatgctataactagttatttttatatgtttcactttaagtaaaatccaactgctcttttgctattcttcgttgatgccttatatgtatgaaagctgtacgttcgggatttgaaaaggaaatgaagacgcgaattaaaaaaaaataataaactggttcatagcagaaaagaggagactaaataagattttgctctcatacagatgcaacacataaaaactttaatcgatttcagtatggaaaaagatatgatacaataaaatctaaatcttagaaactgattttgaataaaaaaacgaccccagtgagggttgaactcacgatcttgcgattaacagtcgcacgccttaaccaacttggccatggagtcagtcacttttgagttctgcaactcttaaaacggaatagactacgtaaaacaatgtcatcccataccaaaacaatcctgatttctcaaaggcatcgcaaacctctggaataaaaatccactatcatctatcaactaatagttattcaatatattatcatatacagtgttagatgatgacataagttatgagaagctgtcatcgaagttagaagaagctgaaatgcaaggattgataatgtaataggataatgaaacatataaaacggaatagtctaacattagtatgtagaaatatggattccattttgagaattcctaaatcctcgaggagaacttctagcatattctgtatatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttatcaaaaatggaatcccaacaattacatcaaaatccacattctctacatggtagcgcctatgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccgtctatgatgacgtgttcacattatcaaacgtcacctgcgtattatcaaccggacccacactatccgttgccacagtatatcccaccactgagtacttcctcacctgatccaatcgattcacagaatcaacactctgaagtacctcaagctgagacaaaggtgagaaataacgtcttaccaccacacactttaacatcagaagaaaacttttctacatgggttaaattttacatcagatttttgaagaactctaatctcggtgacatcattccaaatgaccagggtgaaatcaaaagtcaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacagtcagtacgatcattcagaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcagttaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaatcaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaggaatcggatattgaatggtctaacgctagcacatatcaatgtcctgactgtctaatcggcaaaagcacgaaacatagacatgtcaaaggatcacgactaaagtaccaagaatcatatgagccttttcagtacttgcacaccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaagcaatccaaattggaccaattcaattatgatacactcacctttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgacttctcgtcccaatcaataaaccctttacaattagacaaggaaccagtccaaaaagtacgtgcaccaaaagaagttgatgccgacatatctgaatacaatattcttccatctactatacgatctcgtacaccccatatcattaataaagagagtaccgaaatgggtggtaccgttgaatcagatactacttcacctagacactcgtctaccttcactgcacgaaaccaaaaccgacctggtagtaccaatgagatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaacccataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcactgtcaatcgcattagacaacgactattatatcacacagctggacatatcctctgcttacttatatgctgatatcaaagaagaattatacataagacctccaccacatttaggtttgaatgataaattactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttatcaaaaatggaatcccaacaattacatcaaaatccacattctctacagtatacatattattatagccttaatcaacaatggaatcccaacaattatctcaaaattcaccaatatctcagagactatatctgaaacaaacaaagacgtatagtccaaagcaatattcaaggaaactacaaagtgagattagctacgtagaaataggagaaaaagtataaatttaaagttaaattcagatctcaaattctcttaatatttgaaataaatccgctgcgtgacaaatcccgtgatgatctcggaatatttatatgttaccatttatacttatggtagaattatactcactaatgaatgtacggttactatttggaacaagtggtcatcaattgccatagtaacattttgaatgcttgcatcgtgcatgaatacataccgcatatatgtttaagtatgaatatacctgttaaagaaagtaatgaatctgtattgaagaaccgtaggtttgacatgatctggtcgttatatatacgcgtaatatgactagtcaaactaaatgtatgacaagttccagaactactattacattgatcataagtaataatacacaaatcagcgtgtgttttatacttctcttatatagtataagaagatccatatttaatcttcattaacactacttcttaacctctaattaccaacgggtcaatgttaggataattgttggcattccattgttattaaagggaatcaaagtatattaaaaattcttcccaaggatgtaataacctaaaaaaggaagcccatatttctatataatgttattaatattttctttttcatattattgtcgccactctttattccattacattatcaagtcttgcatttcggcttccattaaatttgatgattatttctcagtctttgtgccatctactcacactcaattttaatatagtgttaatatgaatactaatcaatgagcgatcattggttccattacaataacgttgtgatcggaacttattttgaagttattcctgtcgactgcctgatgtcagtattgaggctgtttgattatttctgaacataatatccttttcctgttacaagtacatgctgaacaagagatatatattatgctttaagatggagtataatggttttagaatattttaaattaagtatgcatacacaaataatctacttactcactatgatgctacaagatcatccattggttaagaatgttgagtgattctacgaacaaggtaactttttttccataattataagtcgtcaaaattgccttggatagctttgctggaaactttcttccgtttattctgtaaaacgatttctttccaatcctctttaatacgctcttcttcagcattttcatcgagctcttctgctttcaattcttcctctatagccttcctttttaaactcatcttttcctttctctcgagtttccgttctttcgtcaatgttttatctgaccacgctaaattcttcttcttcaactcacttttcagcttctttttatcattaatcaggcttatattttttaatgtttcttgtctctccttttcacgttttttgtccttgtatttatattcatccatattaactgggggatcgaccaaccaattccctgggaaaatcccttcttgtttttcggtggctaagtactttgttatctcaggcattctaggcaggcggaaaagaccatacaatttcgcaataccaacataatctaaagattgaagcctaaaaattgaagttgcggaatgatttgagtagtatttaataaaggcaacatatgctttaacacctttatcaaatctatccctatcttctagtatccaatttctaaagtcctcgtaaaagtttgttgttatgccctttacttccaaatcaagttcttcaagttccacatttttaacttgcatgaaaggaataaaatcctcttctctgccttcattaagaaacgtaattgctttacccactctatttgctctaccagttctaccacatctatgcatgaacatatcagtattggtagggggatcaagctggatgacgagatcaacgtcgggtatgtcaatacctctagcagccacatctgttgtgaataaaacagaattacttagcgaatcagtaaaagctgttagagtttttgtccttgccgatgtttgaagttttccatgcaaggaaaatatttctacttcattcacgagaatattcctctttcccaaatactggataaatgagtagaagtaggagactgacacacatgttggaaaatatacaatacatttcttgaatttgtagttattcaaaatgctaaccaaaagttgtagtttttcggcaggatttacgacacagtaatttaatttcaaagaggagggcgcctggttcttagagttaacggtaatcctgacaggatttctaagccctgtcttaaagatatctgatccggcgctacgcatagttgcagaaaatagacccgtccttctttgtttaggcaatagcctcagaattttttcggtatccttaataaaactcatatccaacaatctgtctgcttcatccataactaccatactgcatgctgacgtctttactgctggcatttgtaaaaagtccaaaactctaccaggtgttccaatcagaatctgcggtctattccgcagaaaattacttacatcatctctaactgtggcttcattagtaccaaccaggagctgacatttaatagggaacaagtcggaaggataatgttccagaaatgatagaacgacagactcaatttggcgtgacaattctcttgttggagcaataattaacgagtggaagtgtgctttcttgaattttgatgtattcgcttcttcctttacaactttttctagtacaggtataacaaacgcagcggtcttacctgagcctgttacagaatcaactactacatccttgttgccagcaagcatgggaattgtcgatgcttggactggagtcatggtctcaaaacccataacatcgagtcctgtccttatccagggaagtaaagaaaacccgagattatcccattccaatgactttgacattgtttttattgctgctgagcttttaatattatcttactacacctcaaatcaatgggctcagctcatcttgaaaagctcactttgtttttcagtgaaaaatttttgaaagcgaaaagccggctcaaaataaagaataatatagtattctcgaggtgcccacatgcaatctttactgccctactataacctcccttgaatgagtaatttcattagaaggctagttgggaaaatgaaagcgatttcaacaggtaccaatgctattgttagtaagaaggactccatttacgcaaactggtccaaagagcagctaatacgaaggatcactgaactagaaaacgcaaataagccacattctgaaaaattccagcacatcgaggataacaaaaagcgcaaaatttcgcaagaagaggttacgagaagcaaggcgaaaaaggctccgaagaagtttgacttttctaaacataataccaggttcatcgccttgagatttgcctatttgggatggaattacaatggcttagctgttcagaaggaatacacaccgttgcctacagtagagggtaccattttggaggccatgaataagtgtaaacttgttccctcgatggttttacaagactataaatttagcagatgtggcagaacagacaagggagttagcgccatgaaccaagttatatcgttagaagtccgttccaatttaacagatgaggaacagcgggatccgaccaacgacagcagggaaataccctatgttcacgttttaaatcaattactacccgacgatattcgtatatcagctgtctgcctcagaccgccacctaactttgacgcaagattcagctgtgttcaccggcactataagtacatctttaatggaaaaaaccttaatattgaaaaaatgtctaaagccgcatcatattttgttggagagagagacttcaggaatttttgtaagcttgatggctcaaaacaaattaccaattttaaacgaacaataataagctcaaaaattcttcccctttctgaaactttctattgttttgatctcgttggttcagcattcctatggcaccaagttcgttgcatgatggccattcttttcttagttggtcaatcacttgaagtgccggaaattgtcttgcgtctgactgatattgagaaaacccctcaaaggcctgtttacgaaatggcaaatgatataccattattgttatatgattgtaaatttcctgaaatggattggcaagaacctactgtagatgactataaggcaataaaattcacgacagctactgaagcattgacgttacactacgaacttaaggccgcagtatgcaatatttttaaagatgttttgcccacagcaaatacaaacaacttctcaaagacaattattaatttgggcgatggaagaggtaaagtagtcggtacctatgtgaaactagaggatagaagcgttatggaacctgtcgaagttgttaatgctaaatactccaagaaaaagaacaacaaaaataagtaaaataatatataaacctgtataatataaccttgaagactatatttcttttcatcacgtgctataaaaataattataatttaaattttttaatataaatatataaattaaaaatagaaagtaaaaaaagaaattaaagaaaaaatagtttttgttttccgaagatgtaaaataggttgaaagttagaaattagtattataatagcaaaaaaaatttaaagttagaaattagaatttaaggctctacacacgtttacgatgatattggacgaccgacacgaaaagacagttttaggctttcttttgtcttgctcttgcgttgaaagtacgtaatttccattcgattacttactcaacacttgatatagagaccaactataaaataaactgtttgggaaggaaagcagaactcttgtaattacctcatctcattatcaagaagcaaaattttaactatgtattttgaccttatttttgtactccactttttttttttagttttttttagttattttttaattttgaagtaacggcgatgaggtgaagttttttttaaactgaaaaagaagatcgaatgcaaaccataaattagagatctaattgaggtaaaattataaggttagatatctgtaaatctatacaattaaggaaagatggcaccaaagaaaccttctaagagacaaaatctgagaagagaagtcgcaccagaggtgtttcaagattcacaagctaggaatcaactagcgaatgttcctcatcttaccgaaaaatctgcccagcgtaagccttctaaaaccaaggttaaaaaagaacagtctttggctagactttatggtgcgaagaaggacaagaaggggaaatattctgagaaagacttgaatattccaacactcaatagagctatcgttccgggtgttaaaataaggaggggaaagaaaggtaagaaattcattgctgataacgacactctgactttaaaccgtttaataacaactattggtgacaagtacgacgatatagctgagagtaagcttgaaaaggctagaagattagaagagatacgagaattgaaaagaaaggaaattgaaagaaaggaagcgcttaaacaagataaactagaagaaaaaaaagacgagattaaaaagaagtcttctgtcgcaaggactatacgtagaaagaataaacgtgatatgttgaaaagtgaagcaaaagctagtgaaagtaaaactgaaggaaggaaggtaaaaaaagtctcatttgctcaatagtttgattgactaaactaaatacggataagtctgttgtataatatataacatcctgaaggcaaagtctttgtaaagattgtgctttatagaacggtcaatatcgtcatggctgatgctactctgttcatcacttctcttctttatcgaagaccgggtaataataaatatccgaatttttttcaaattttgaaaactcactcacgtcttcctagaagatttcaaatgcattaattcatcaaaattcaaaacttaacaacacttgtgaagaaaagtcacaaagaagtaaacgatatgctggagacgttgcgcggaaataagctgcattctggcacctcaaaaggcgccaacaaaaagttgaatgaactcttggaatcgtccgacaatctaccatcagcatcctctgaattaggttcaattcaagtaagcattaatgaattgagaagacgtgtttttcaattgagaagcaagaacaaagctagcaaggactatactaaagcccactatttattggctaacagtggcttaagctttgaagatgttgatgctttcatcaaagacttgcagacgaatcaatttttggaaccaaatccaccaaaaataattgaaagtgaggaattagaattctatataagaactaaaaaggaagaaaacattttgatgtctatcgaacagcttttaaatggcgctacaaaagattttgataattttattaatcataacttaaatcttgattgggctcagcataaaaatgaagtcatgaaaaattttggcatccttatacaagataagaaaactgtagatcacaaaaaatccatcagttctctagaccctaagcttccaagctggggtaataagggcaataacattttaaatagcaacgaatccagattgaatgtcaacgaaaataatatccttagggaaaagtttgaaaattatgccagaattgtgtttcaatttaacaatagtagacaagcaaatggaaattttgatatagccaacgaattcatctcaatattatcttctgcgaacggaacaagaaacgctcaattgctagagagctggaagattctcgaatcgatgaaaagtaaggatattaatattgttgaagtcgggaaacagtacctggagcaacagtttttacaatataccgacaatttatataagaaaaacatgaatgaaggattggccacaaatgtcaataaaatcaagtcattcattgatacgaagttgaagaaagcagacaaatcatggaagatttctaatttaactgttatcaatggtgttccaatatgggccttaatattttatcttttaagagcaggtctaatcaaggaagcattgcaagttctagtggagaataaggcgaatatcaaaaaagtagaacaatcattccttacttatttcaaagcatatgcttcttcaaaggaccacggcctaccagtggaatattccaccaagcttcatacagaatacaaccaacacataaaaagttcactagatggtgatccttatcgtctagctgtctacaagttgatcggaagatgcgacttgagtagaaagaacattcctgcagttactttaagcattgaagattggttgtggatgcatctcatgttgatcaaagaaaaggacgcggagaatgatcctgtttatgaaagatattccttagaagacttccagaatataataatatcgtatggaccatctcgcttctcaaactattacttacagacccttttgttaagtgggctctatggattggctattgactatacttatacatttagtgaaatggatgcggtgcatttggcaatagggctagcaagcttgaagctatttaagattgatagctcaacgcgcttgaccaaaaaacccaaaagggatatcaggttcgcaaacatactagctaattataccaagtcctttaggtattcagatcctagagttgctgtcgaatatttggttttaataactctaaatgaaggacctaccgatgtcgagttatgccatgaggcgttgagggagctagtattggaaactaaggaatttactgttcttttgggtaaaattggacgcgatggagctagaattccgggggtgatcgaagaaagacaacctttattacacgttcgtgatgaaaaggagtttttgcatacaattacagaacaagcagcaagaagggcagacgaagacggcagaatatatgatagtatattactgtaccagcttgctgaagaatatgacatagttattaccctcgtcaatagtttattaagtgatacacttagtgcgtcagatttagatcaaccattggttggacctgatgacaatagcgagacgaatcctgtcttgttggctaggaggatggcgtccatatattttgataatgctggtatatcgagacagattcatgttaaaaacaaagaaatttgtatgctgctcttaaatatctcctctatcagggagctatatttcaataaacaatggcaagaaacactatcccaaatggagttattggatttacttcctttctcagacgagctatctgctagaaagaaagcacaagatttctctaatttagatgacaacattgtgaaaaatattccaaatttgttgattatcactctaagctgtatatcgaacatgattcatatcttgaacgaaagtaagtatcaatcgtccacaaaaggtcaacaaattgattccttaaaaaatgttgcgagacaatgtatgatttatgctggtatgattcaatacagaatgccaagggaaacgtacagcactttaattaatatagacgtctctctatgatttttttaaatattgtatatttttgtttatatctatatatcagtatgcgcgcatacttagtaaaagtataaaaagccatttgctgcttcatcgaatattttggctttcgttgtacaaagcctcagtccttcttttcctgctgttttcgcctgtattcagaataatctggttggatttcataagcattggggctatatgacctttttttctcaagtttacgatggcgcctttccaatcttctttgtctacgttcgttaaagtcaagatccttctcattctcagattctgaagaagaggatccggaagaagaggatccatcatcatctgaatgatggttgcactcttcttcatcctcattttgtggatgaaaaatgcagcatatcttggtcttttttttattcatgttttcattgtcaatcacattttcttcccatcttacattgtgccttgtaggcattgcctcctggcttcttggaggatcttgagttgctcgaagctgcaaaactgcgggaacctcttccacactcaccgttcgggaccctacggtctgttgttgttctgatcccatagccatttgatttccactcatccttatagacttaattgaagacttagctcgcaactcctggcagttataagctcttgggacccttgactcgaattgtttctaaatgataaatacggccccttgtttatactgaaacgcacgtcgctgatgatttcggacctccaaggtggcaaattcacaagaaaagcctttaagctaagaaacggtttatgaccagtattaatattgagaaagaaaaatagcaggtgataacacaattaagaggacttaacaagaaagacgagacataatggaacgactacagagattgatgatgaatagtaaggtggggtccgcggacaccggccgtgacgatacgaaagaaactgtttatatttcttcgattgcgcttttaaagatgctaaagcatggtagagctggtgttcccatggaagtcatggggttgatgttaggtgagtttgtcgatgattatacggttaacgttgtggacgtgtttgcgatgcctcaatcgggtaccggagtttctgttgaggctgtcgatgatgttttccaagcgaagatgatggacatgttaaaacaaacgggcagagaccaaatggtcgttggctggtaccactctcatccagggtttggctgttggctatcttctgttgatgttaatactcaaaaatcttttgaacaactaaacagcagagctgttgctgtcgttgttgaccctattcaatccgttaagggaaaagttgtcatcgatgcttttagattgattgacacgggcgcattgataaataacttagagcctagacaaacaacctccaacacaggcttattgaacaaggccaacattcaagccttaattcacggtctgaataggcattactattctttaaatattgattatcataaaaccgcgaaggaaaccaagatgttaatgaacttacataaagaacagtggcaatcaggtcttaagatgtacgattatgaagaaaaagaagaatcaaatttggctgctacaaagagtatggttaagatagccgaacagtactctaagagaatagaagaggaaaaggaattaaccgaagaagaacttaagacaagatacgttggtaggcaagatccaaagaagcacctttccgaaacagcagatgagacactagagaacaatattgtttctgtgctgacggcgggtgttaattcagtggcaattaaataaacaaattttataaagtcattatgcattaaataactagaaagcccactacatatatattatattgtatttttctaaaaattctaatgaagtagttaatggaatgaatgggaaagagaaaacgcgttaggagggaaaaggctccttaaataacagtaaaaatgaaatggctactggtagtcccagtgccaatttttttttttactttcttttctttcactcttgcttttcccatacttgtataaacgtttccttcaaaaataaaagctcggcttctctctctgtcgtatttatgccatctatttctatccatttttcacttttgttatcatacagctgagtaatccaatggcttttttcatcaccattaaatgcgtttccatctgtggatggttgtttaatgaccacatggaccacatttgcttttaagcgatacttgacgtgcaaaatttcaagttcactggaaaattccaccaacgtttggtttctatttttgacaggatgatcactgttacggtcaaacctattgaaatgaaatattaaaaactgcggtaatcgcgttagttcaaaaacggtgctagtagaggagcttcttgacttagtaaatttagtcaataatttagtgatatttatttgtgggagatcatcaacgctgttgccatcttcaaagggtgaaaactccggcaaatcgagagtcagaacccaaaatggtttgacaatgacttttcctgtaacagactcactggcctcaggcttattttcaacttttgctatctttactttgcctttacaagaatggtttaaaattgactttaagtcgttcgaggacgagcaaattttattgaatagccacaaaaggaagagacgcgggtctataggatttaaatttaaaccttctctaactttcaaataggatacaaaatcgtcaactgaaagatgatgtttgaatagtttaggggaccaaattttctttacacatatggataaccttttgataaattccccttgattatcaaaatgattcagtaggaagtggtcccgcactggaaccatgtgcgatatcaaaagcaatacactatgcgcatagtcataagttgccgcattggtgaaccctataaatccattcagatatgtgcgattgctcaaatcaaaacactgtctcggaaaatcttctagatcttttggacaataagtcggataagctgcaaattttatgctgttcaacaattgaacctcaccgtcatgtaaaatttggacattttgcggcaacatgtaaaacttcaaacttgtcaaattcaagaagacgtgatggttttcatcaattgaatgtatgaaagcaggactcttttcatgtctcccctgataataatgtccacacacgaggcaacaatatacattcaaaggggacagagtaatgcagcaaattttctcagaatcgaaatctagtttttctcttactacagtctcaagataggcatagtttggttcctgagactttatcttttttactgcctcctgttttaactcatcttctgaatgtctccttttgttatcaacctccattataaacagcgctttaggttaacgcccactaaatgatgaaccatgaagagcatggttagattgctgccaattttttttcctatttcgtcatttttttatcaagattttccagtttttttttttttttggcattgcttactatacgcgagggaggttcaattgacactttccgctacggcgattcttcagaaactgtgtcatcttttttccaggtcgagctgtaggaaaacctgggaaatataggtatatacctgatctgttgttggagtgatgtgccttgaaccaatctctcttgttgttttcggatccctggtgtttttctttggcttggtgaagtatttcaaacgtggagaacggcaaagaacaagaggaattttacagccagagtacaaagataagtattattacagtaaagaaaaaggggaagaaatgggcgaggtagcaaacgtaaatgaaattccggtcaagataagaaatcataagtatcctgcgaaagaacataacttgagggttaaagatttgttgttaaatcgcaatccgaagctatcaaagatatccacagcattttttattgctggtgaagaattagagggaaacaagtattgtgacaccaacaaagattttagacagaatagatatttttatcatttgtcaggtgttgatatacctgcttcggcgatattgtttaactgtagcacagataagctgacattgtttttgccaaacatcgatgaagaagatgtcatatggagcggtatgcctttgagtttggatgaggcaatgagagtgtttgacattgatgaggccttgtacatatctgatctggggaaaaaatttaaagaattgcaagacttcgctatctttacaaccgatttggacaatgttcatgacgagaatattgcaagatcactaattccttcagaccctaacttcttttatgctatggatgaaactagagcaattaaggattggtatgaaattgaaagcatcagaaaagcttgtcagatttcagacaagagccatttggccgttatgtccgcgttgcccatcgaactgaacgagttacaaatacaagctgaatttgaataccatgcaacccgtcaaggtggtcgttctttgggctatgaccccatttgttgttctggaccggcatgtggcactttacattacgtcaagaattcagaagatatcaaaggtaaacattccatcttaattgatgcaggtgcagaatggagacaatatacaagtgatatcaccagatgtttcccaacttcaggcaagtttactgcggaacatcgtgaagtttacgaaaccgttcttgacatgcaaaaccaagcaatggaaaggattaaacctggtgctaaatgggacgatttacatgcactgacacacaaggttcttattaaacatttcttaagtatgggtattttcaagaaagagttttctgaggacgaaatctttaaaagaagagcttcttgcgctttttatccccatggactagggcatatgttggggcttgatgtacacgacgttggtggtaatccaaactatgacgacccagatccaatgtttagatatttaagaatccgccgtcctttgaaagaaaatatggttatcactaatgaaccaggttgctactttaatcaatttttgatcaaagaatttttggaaaagcaccccgaaagattggaagttgtcgatatgagcgtattgaaaagatacatgtatgtcggtggtgttagaattgaagatgatatccttgttaccaaagatggttacgagaacttaactggtattacttctgaccctgatgaaattgaaaaaatcgttcaaaaaggtttgaagaaaccccgttcaggtttccacgtaatcgtttaggtattaacttttttttactcgcttctagaagtttagtatattcttttgtacacagaattgtatattttttttataatcttggattcaccatttaactagatttggaaatataaggaatggcactgaaaaaattaaggaccaaccccgaagagcaaaaaatgaatgcgaattctgtggatcgaacacaggacctccagataacttgaccgaagttttttcttcagtctggcgctctcccaactgagctaaatccgcttctatttatgaaaaattcattgttacaggaactataggactataataactagctgctaacacctttaaatgtgacttttctcataaggaaatctagcgattcagaattcgagaattttgcagattgcaaagttttctttttaccataatatttgagaatgttgtaaaacttgagataattattcggatgtcattgttgattgaagatagcattcctatgagtcgccctcgaggacttggatcgaaaaatctacataatattagtaattactattattgttggaattggataaaccgtcgtccacctatttgagaaataggtaattattatatgagttatttggttcctttttgttaaagtaataatttgaaatgccatccatttggtaatattcatgttattggcatattatcatatgcggttcaggaagatgacataaaagttgagaaacagttatcaaccctaatggaagctgaaatgcaagattgataatgtaatagcataatgaaacatataaaacggaatggggaataatcgtaatattattatgtagaactaccgattccattttgaggattcctacatcctcgaggagacttctagcatattctgtgtacataatattatggtcttgatcaacaatgcaatcccaacagttatcaaattattcagaaaattgatcacattttcgataaatctattatgaaagtaaaattttgactcatacctaagttctcgttattcgttaatcttatgaactcattaaccttggcgtttcagcatccgctatgattactagtgcttaaaccttgttattcatgcctcataattgatgccatcttctaacctcgagcgtgataaaatttttgtaatatgaacaccaatcggcggaagatcatcccaaagccacatatgatggtgccttataacattaataacaacttcaactgctgcataccgataatatcttgacgattatgcattcgtgtcctgatagctaatgccatgaaacaattcttttcaatcgcacttgcaccttcgtgaaatagaagggttatctgggcttatcagacttgtccacagtttacatataattttttttctgtattaaattttgtgagctttctttttactcaaacgaactgtgttatttttcgttcattaaatgcgtacctttaagcatcatcaagtattgctcttcgggaaaaatgaagtaaccttgttaggttaatttcactagtactatacatattttatcctgtatcataccagaggatcattctagccacaatggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaataaagtagctgaaatgattgaaaatcaggggctgtttaaagatcatgttgaggatgttaattttcaaccagtcaagtactcagcccttacatcaaataatgaagaatgtaccgcagtagttgccagaggtggtactgcgaatgccataagaatcgcagcagttgataatccagtcaatgttaacaagttggcccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacttcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctactgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactagaaggttaggcggaaccttgtatatatttttgtaaaatcgaactgaatacagataattaaggcgcgcaagcaaaaacggcattctttatgaactctgcagaggtgccctttattacgacatatatgggaagtaatacatattgattctacaagaagttcaagccaaggtttagatatgagtgaccaaatcaacgttttgtcaatgcaacaacaacaacagcagcagcagcagcagcagcaagtatatatgtctcctcaagcagaaaacttgaatcatatgtacttgttagttaacaagctagtgaaacagttgagggaaaatcaagcagaaaaggcgaaaatactaaggaacatagacatattatccggaagcttaaacaagtatgagacatctgaagaacctcacgataccacggaaaatattgcattatttaatagatttctagaacaaagagggaaagctcctattactgagaaagagcaactaagcaacaatctggatgaaaatgcgaaagatgacgttatgctaggagtgttgaagcgccaaaattcaatgctccggaaaagtttacaggaatccaagcaggtaacccttgaatccatggatttattgtcttactccgaagactctttaaattacattgtcgcccaattaagaggaaacattctaatgcatcataaagagactatcaaattgattaggcagaaattccagacggagacaattcccctcgaagatgaagagttcaagatgtatttggaaaatgttaatggtctgcaaaaattgacagatatatctcacacttatagattactactgaggttacatgcacaagattgaaactttgcccttttgcttccaatgaaagcaagatgacaaatatacatgcttcttatattcgagattgcgcaaaaattcgaagctcatttatgaaggctttttccattctgatatatgtttatgaaattgaaaaagtaacgacggtggaacattttgcgggaaaacaactcacagaatgtcttgacgttcttttcctgcagttgcgtgcgtaagatatcctaagctactgtattatttgccaaaaataataaaatgttggaggaaagcctctataaatacacaggatatatatgtttaataaacatatataatttcctcaatatttgcaaaagcattttgttgtgatgagagtcgattatcgtttaccgattagtatctatactattaatatattttcatataattagtataatctcatatacgctgccagaagataacatgaaaattaagaaacaatcatcagcttcaatggaagttgaagtgcaaggataaataatactatttagaaatatggattttccctcgttgactagaagatctgtgaagattgggtgaatagtttaataattattggatcccattattgatcaaggctataatacttgactatttggcgaattttgagataattgttgggattccattgttgataaaggccataatattatgtatacaggatatactagaagttctcctcgatgatataggaatcctcgaaatggaatctatatttctacatactaatattacgattattcctcattccgttttatatgtttcattatcctattgcattatcaatccttgcacttcagcttcctctaacttcgatgacagcttctcataacttatgtcatcatctttacaccgtatatgataatatattgataatataactattagttgatagacgatagtggatttttattccaacacactaattatcattcgttacatctcaaattggttagagaagttacaaacattattattgatttatccaaggatagttttcacaagaaaacaagcgcaagtggtttagtggtaaaatccaacgttgccatcgttgggcccccggttcgattccgggcttgcgcagtttcttttttttctgatttttatttttttgttcctgaaaatttttcgtattattagatctagtagaaaatgaaagacatttgaaaagagaaatatatattctgcagtaagctagctaagactagtcgttttgaagcgctaaaacgttaacttcgattcatagcacaaaaggtaaataacttttttgaaatggcaagcatcggttcgcaagtgagaaaagctgcttctagtattgaccctatcgtcacggattacgcagtgggctactttaaccacttgtccggaataacttttgatgctgttcaaagtaagcaggtagatttgtccactgaagtgcaatttgtgtccgatttattgattgatgcgggtgcgtcaaaggctaaagttaaagaactatcggaaagtattttgaagcaattgactactcaactaaaggagaacgaagccaaattggaattgaccggtgatacgtccaagagattacttgatattaatgtcttaaagagtcataacagtaaatccgatatcaacgtctcattaagcatgctgggtgtgaacggtgacatcgaacatactggtagaaagatggaaacaagagttgatttgaaaaaactggccaaggctgaacaaaagatcgcaaagaaagtcgccaagagaaataacaaatttgttaaatacgaggcttctaaattgatcaatgaccaaaaggaggaggattacgattctttctttttgcaaatcaaccctttagaattcggttcatccgctggtaaatccaaggatatccatattgacactttcgacttgtacgttggtgacggtcaaagaattttgtccaacgcccaattgactctaagttttggtcacagatatggtcttgtgggccaaaatggtattggtaaatctactttgttaagggctctatctagaagagagctgaacgtccccaaacatgtttcgattttacacgtggaacaagagttaagaggtgatgatacaaaggctttacaaagtgtgctggatgcagacgtttggagaaaacaactattaagtgaagaagccaagatcaatgaaagattaaaggaaatggatgtattaagacaggaattcgaagaagacagtttagaagttaaaaaattggacaatgaaagagaagacttggataaccatttgatacagatttctgacaaattagtcgatatggaatctgacaaggctgaagctagggcagcatcaatcttatatggtttggggttcagtacggaggcacagcaacaacccactaattccttttccggtggttggagaatgagattgtccttggcaagagccttattctgtcaaccagatcttttgttgttagatgaaccttccaatatgttggatgtgccatccatcgcttatttagcagagtatttgaaaacatatccaaatacagttttgacagtttctcacgaccgtgcattcttgaatgaagtggctacagatatcatttatcaacacaacgaaagactagactattacagaggccaagatttcgataccttttacaccacaaaggaggaacgtagaaagaatgctcaacgtgagtatgataaccaaatggtttacagaaagcacttgcaagagtttattgacaaatacagatacaatgctgccaaatcacaggaagctcaatcaagaattaagaaattggaaaaattgcccgttttggagccacctgaacaagacaaaaccattgatttcaaattccctgaatgtgataaattgtctccaccaattatccaattgcaagacgtttcctttggttatgatgaaaacaacctattattgaaagatgttaacctggacgttcaaatggattccagaattgcccttgtaggtgccaatggttgtggtaagactacactgttgaagattatgatggagcagttaagaccactaaaaggctttgtatcaagaaacccaagattacgtataggctacttcactcaacatcatgtggattctatggatttgaccacgtctgcagtggactggatgtccaaatccttcccaggtaaaactgatgaagagtatagacgtcatctaggttcatttggtatcactggtaccctgggtctacaaaagatgcaattattatccggtggtcaaaaatctcgtgtagcattcgctgcattgtgtttaaataatccacacattttggttctggatgaaccttctaaccatttggataccactggtctagacgctttggtagaagccttgaaaaatttcaacggtggtgtcttaatggtttcccatgatatctctgttattgactctgtttgtaaagagatttgggtttcagagcaaggtactgtcaagaggttcgaaggtacaatttacgactatagagattacatcttgcagtctgctgatgctgcaggtgtggttaaaaagcattgattatttaggaagcacctcagaatatattttccatagaagcctaaattaagtatgcattcatagccccatgatacttttttttttgactacttgtattggaatctaattgacctaactgggcattctgggtcattggtatatgtatcactttttacgtaaaaaagtagtggctaatataaaacataaaatctacaagaagggtgaagtgcttttcgaattttgccactgcaagtaattggtgcaattgaaatacgagatttcgttctctaagaggatataaaaataaggaaattagccctacctatccttgtgttaaaatatgagcggagaaacgtttgagttcaatattagacattctggtaaagtttacccaataacactttccactgatgctacttcagcagatttgaaaagcaaagcagaggaattgacccaagtcccaagtgcccgccaaaaatacatggttaaaggtggcttgtctggcgaagagtccattaaaatatatcccttaatcaagccaggatcgacagtaatgctattggggactccagatgctaacctgatttctaaaccagccaaaaagaataatttcattgaagaccttgcgcctgagcaacaagtccaacaatttgctcaattgcctgttggtttcaagaatatgggcaacacctgttatctgaatgctaccctacaggctttatacagagtgaacgatttaagggatatgattcttaattataacccttctcaaggtgtgtctaacagtggtgcacaagatgaagagattcacaaacaaatcgttattgaaatgaagcgttgttttgaaaatttacagaataaaagtttcaagagtgttttgccaattgtgttattaaacacgctaagaaagtgttatccacaatttgctgaacgtgattcacaaggtgggttctataaacagcaagacgctgaggagttgtttacacaactattccatagtatgagtattgtttttggtgacaaattttccgaagatttcaggattcaatttaaaactaccatcaaagacacagctaatgataacgatattactgttaaagaaaatgaaagcgattctaaattacaatgtcatatttctggtactacaaatttcatgagaaatgggctcctggaaggtttgaatgagaaaattgaaaaaagatcagacttgactggcgccaattccatctatagcgtcgaaaagaaaatatcaagattaccaaagtttttaactgttcagtacgttagatttttctggaaaaggtcaaccaacaaaaaatctaaaatattgcgtaaggtcgttttcccatttcaattagatgttgcagacatgcttaccccagaatacgcagcagagaaggtaaaagttcgtgacgaactgagaaaagttgaaaaggagaaaaatgaaaaggaaagagagatcaaaaggcgtaaatttgacccatcatccagtgaaaatgtcatgacaccaagagaacaatatgagacacaagtggctcttaacgaaagtgaaaaagatcaatggctcgaagagtataagaaacattttcctccaaacttggaaaaaggtgaaaacccatcttgtgtttataacttgatcggtgtcattacacatcaaggtgccaattctgagtctggacactatcaagctttcataagggacgaactggacgaaaataaatggtacaaatttaatgatgataaagttagcgttgttgaaaaggaaaaaattgaatctttagccggtgggggcgaaagtgatagtgcactgatcttaatgtataaaggatttggtctgtaagtccatttttcattttttcaaaattaatagttttttcggaatatacatatacatttttttacatacacataaaaatatttctctcccttttacgttcatccgccaatcgataaaaatgcattttatatacatgaaatggcgaattctttttggtcgagtttatgtatactttttcttattcaacccataacgagcttcttgaattcttccatctcttcgtaacaattcaatggcttgcccttattggccaaaagacactcagtcaattttgcctttatagaaatgctgccgttgtcggtttttttatcagatttacctttggcacccccatatttctccaacttttgtaactctaattgatcaaataatgttagtttcttgttcaacgactcgatttgattattcaatgaacttgatgatattccatcaacggcatccttgtcgtcgtctgataatagtgaattgttcaaagtatcttcaaacttctttaacgtttcaacttctaggttagatagcctttgtgaaaccttcttctcaatgaacttttctgcattttgcttggtgacatagtctgattccttcgatgaatccaattgagaaaccaaagactgtgaaaaatcgatctgtgttagcggagtatagacttgttgtttttctgcaccagcacccactttggaagtgtttgaacccatgattgactctgtattagtcgatataccaccttgtttttgttcttgaatttttttttgattagcaatctctttgaaatgttcctcctcacttgttttttcctctgcgtctcattggaagaagaaatatatatatatgcgacataccacgaatattcgtagttttttacaacaaaaacgactctcggtagccaagttggtttaaggcgcaagactgtaatttaccactacgaaatcttgagatcgggcgttcgactcgcccccgggagatatttttttaaatcttgcagctttcaatatttaaatataagtaataaaccatcagttaaacaacagaacaagtatttcttaaatctcatgaaaaatctaataatgttatttgccgaattttattattgatttggttggtcttcttgataattctgtgggcgctttttttgtgacatattaaaattgcgaaattgcaaacgaaaatataaatatatatgaatgttaataaataaattatttaattgatgattgaggatgaaatacacttttatgatctgtccttacgcgtaataattacaagaaggtgagaaaattgcctttttttgctaattttttttttttggtaccatattcaataattgatgctaaattataaattgattttattgttttcctctttcctacaattaatctctttttctggctttatgatatgttgtttaacttcaccaataattagaaactgggggctggctcaagctgctggagtttcatatggtacctttggttactgtaaaactttgaattctttttcctgctctcgagtacgtttaatatataacacctcgaaagaaatattacctggcccttctcttgaacgttggtggctgagtcctaaggcaagacatacaataggaggacttttgatttcgataccggttgctacatgtttgactttcatttcttttgcacttcccttggttattatttttctttttcagactggaggaactaatgtctcacttattacttccaacgctatattacacatattgacacttttatcaactatttttgcatgcaccgtgatcctgttactttgcatgcaccgtgatcctgttacaatttcatccttatacgacttggtgtggctggctaactgttccctgttccctctgctcgttattggcgtgcattttctcagttttaggtttgatacgtctgcgcagtcagacagaaaacatagctaaagaagctagtatagagaacgtagacagtattctcaaactatatggaacgagtcaaacatcaagttcccttggcgaaaattatccacaaacaactaagggcacagaccaatctgtgtatgacatcacaagtctttttaatgatctaccaaggaccttagatcccaatcaagataaactggcggtaacaaatcaagatgaaccaccgcctgaaatcaaatctccattgaagcaagcaggtttggtgagtttcttcgctccaaagttgaatggtaaacaaatattttctagaaggcatgttgaaaatcaaaaatccttatctttggatgaaatcaatataaccgacttacctgcaaagcaagaaaatgtggaaatgcctactgaaaaaaaaaggcaaatattttatattatgagggaatctcaagccattcacaagataactacgaccctccttggttatttggcgttgaggctacccaatcagccgattgctttaaaatatattcaaaaaaaaatcattgtctcacagagccccgccaatatcaactacaacaaccaaataattaccaggatcaaagtgaggttcctcataactctttcattccttggtattcccgaagaagaccagtaggatacaaccacaattacaatcgctactactcacagacaactcatggtaacagcgaacactcccgacaaacattgccacagacctacaacatacacagcatgctccccagaaagtacaagcccgcctacaaaaaacaggcacatcgtgtgaagagtaatccacaaccagcttatactttccaatgacaaaataacaagaataaagtactatccaatctgctttttttgtacgcgttttgttggcgcgccgcaatttgaaaaataagaataaagtacttcttgctactatttaatgattccatccgtattccacatcgttgacgtctgagtctgatagactagtatatagaaaataaaaataagatagagtaaatagtatgctacttttatcgagcccatctttttgagcttaatttctgaaacaaagaaaggaagtgcccatttttcctcttaacggtttctaaaattactgaagagaaaacaacttttagatgtaatttatttacattaacattagcagtgactacagaggacaggtatggcggtatggcggtatttgttaacattgactttccttatgcgtggaagtactagtaatattccctctcggatcataaaagtgaaatatcgtgcttcacgatttgctgaaactttaacaaattcattgaaattacgtgagtttatactaatgaatggacttaatttcttaagatggtgatatcttccacattggtttcggccaacaaaactatcacttaccaagtacttcaagcaaagtttgcaatcccctattgtttatggattctccatccaattctatccagaatttgcagcaagaagcccagggcagctcttccgcacagcttgctgaccatgatcatgatcgcgtatcaatggctatgcccttacaaaccgatcaaagtgttagtgtttcacaatcttctgataatttaaggagatcaagacgtgttcctaagccaagaacgagcatttatgatgaatacgaggaagagttaaaggaaagggcgaataaacccaagaggaagagacctgctcctcctaagaaaaaggcaccttccacacagaactctaaatcaaatgataaagtagagaaaaagaagactacctcaattgctaaggatggcaaacctacactgaagactaatgacaaaaaagtggcgccgaaacctaaaccagcccatgaacaagtagaacccgctttgatccctagcaattggacttctgtaatacccttgcttacttctgatttcaagaaccagtatagtgtcatctctaggttaaaaaatccgaacatgaagcctgtgccatatgctggagatatcattaagctgatggcgttcataaataagtttagttcttttttccattctgacctacaaaatttatcattccaagattttgaggtcggtttagatttgtatcccggcgatcctaatggaagcgcagctggtatagtgaagggtcctgaagacacctccttattgctatatcctgattttatggccatcaaggatatcgtctattgccaagacaaaatgaatttactgttcctatccttgttagatttaacatttactgaaaattttgatggtaaaagtgccaagaagaaaggtccattaacaacctgggagaatctaaaatcgtcctccaagaaagtattttccaatcctctttatcggttaagacttgtagctcgcgaatgggggtatccacgagaatggcgtcaacaactccccagtgaccaagatatctccaaacctaaaactgctctttttgaacaagatgaacaaacaccagtggtggatcccagtcatccagaaattttaacgccaaatatatatacctggaatgctaatgaaccactcccattggaatcaaatcctttgtataatcgagaaatggacaagaatggaattttggcgctcaaaccaatggatcgcgttgttttattgagggcgttaactgactggtgcgcttcccattcatctgctattcatgacgagatatacaaattaactcatggtaaaaaagatcccgtttttggcatccaaacacaacaagtgcctaggtatacaattgaaggggtagataataccataaatcagtttaaaaaactctgctcactaattcaatcaagatatgaaatcagaagtaagaaaaaacattttgttaaacaactaaaagagggtaaaaaaccagatttatcaaggaagctagaaatactgaaggaaattaaagcggaattgaagaacgctgtaaaatccgaaaaggatgaacttttgttctcactgtacgacaagtgggtcccattgtttgaaggcgaattacctgatcaaccattagccaatcctttttcggaaagactttataaattgcgattacaagagttcttccttggtagagttccccatataggtgatttttatatgccaagattacacagttatggggactcactcgaaatgagcaccttcactgatttgagaaatctacaagcattgctatcgaaattcaaaaataatgaatacaacgcttttacactgtttgaaaatgatggacaatcgatgagtgcccaattcaaattgttttaccatgacacaccatcgttggcgcatgatgttgcacgaggcagaaatacatcggggaaggtttattggtatgaattatgccacgattcagcaacactgctggagttcttggagttcttggactataaaattgttaaacctcaagatgagaaaaaggagggaaatgaaaaagaaaaagaagcactgaataatgaagcgcacatattggagcagaaatctaccactgataataatccctccataaatacaaacccgctaccaaaagacgcaaaatataacactgcgagaaagaagttacagatattaaaggaatttttatctgattactatttcattcttcgtcagtttgaacaaatgaaagtgcaatttgcagacatgaagccaggcaagagacagttgagaaggatacagcgacagactgtaaactataatacggaatatgatagcgaggaatatgtcgatgatgaagaagacgacgaagctgatatttatgatgacaacgacaatgattcttcttttgatgatggtagagttaaaaggcagcgcacttagacaactagctttcaacgaacgtgaagattgtgaaactccttacaggctgcatttcgattaattaagtaatgtaaaattaagactattagtacataattagatacgcgtatcttttcaactaaggcataaaaaaaaaaggtagaaagtgaggacgaaaaagtgcaaaatatcaaagtcaaatcttgcgcatattcgagcttacaaagtcattgaagatttattcgccagtgtggtaaaacggcatactgttatcattcttctgttttggtatccttcccctctggtttctccttcgcctcatccaaagactttatatcactcccaggaagatcgctatcagaactacagactctgttaatatttaaaaatttttccttttcggcaagcactgtgttaactaattgtgcaaaagctttgctggttaactcggacttcaacttagactgttcttcttctgatagcttcttggatagttgactggtatccgttgctttcaatggaggaactgaaccgtttgcttgacttccttcgtcaaaatctgaatcactctctgtctgttcaagatacagatctcttaatttctggatcttcatgtttaatctgactctctcaacagaattacggaacttttgacgagcatccaatccttcctttaacccaggcaataaattgtgcgtcttcaattcggtacaaataatccatggatcttccaagagttctgcggcggtcggtctctttgaaggatccaaattaagagccttcaagatgaattgttttgccttattggaaacggaatcccaataaggcctatgaaacttcactggatactcaccagttgtgcattcgtcaaggaaatcttgaaccctttcggctctaaacgccgaataaccgcaaagcaaagtatacgtaatgacacctatcgaccaaatgtcgcaaggtttaccatgaccgtcctgagtaagtacctctggagccacgtaacccagtgagcctgccggcttatagaggagttcctcatcacttttcaatctctttgcgataccaaaatcagcaactaccagtggagattcgtcacttttatctatatacagtaaattttccggtttcaagtccctatgaacaatattctgagaatgcatatatttgactgcgctcaatatttcaaccaaaattctcactgcatcttcctcagtgaacttacccttcttcaaaatcctatcgaacaattcaccccctttggctaattgcgtgataatgtagaacttgtcttttgattcaaaccaatccttaaatgccactatatttggatgatgcagtctttgtaaaatgtctaactcgtcgtataaagcctctagctgaaccttgtttccctttagtgctttcttgatcaggattttaacggccacgtcctcccctgtttcagtgtttttggcttgtctcaccacaccaaatgtaccagcacctaatgtcttcccaaaaacatatttttttttattcacgtacgaagcaggctgcacatgtgccattttaccttcagaatcctcctctgtttgttttggggagctctccttttctgaaactttgtcgtccatagtaattgactcgttattttttctggtgtcttccaatattatataattgtgagttctctacgagaattgaaaccatttatactctggcttgtagtcgatgtggctttcgttctttttatcccctgcgtaggtagctcggctgcaccattctaaacgcggggggagtttctttttttttttttttcagccttttcttcgtaagcaaagtatcccacgtaaaaggttccttatactaacacatatgtactgtaaaggtaaaattacttctattttttctactgctattatttctatgtacttatacaagaataacagaacgtgcaatactaaaattaatttgatgctcagctaaaagagtaagatatgttagcagaagttaagatggttttaattatcctcgtagtatgcagacgtatcgttgtcatcatcgtcattgtcgatggctccattcgtgctcaaattaaaatagtcatctgcattattagcatcttgaagggtacctaaatcgcccggagtcatgtaaacagtactattggaccttactttgggggatccgggtacactcaaaggcctggcaatcttgaatttcttgccaccggcaagagtattcatattggcgtcactaattgtttcacccaccagttgcttgaactgctctggataggccctacgaagacccaactgtctagccttaacgtattccaaccccattctcttccaatctaacaagtctgatagtctttcggttctgtttctttggttgattctttgtcttctggtcttgtttacaaactcttccatgtagtctgctaattgctcgacagattcatcagggctcttgaaacgacggtctacaatataaataccatagtctttcgcttggtctgtttcaatcaagtcttccatgtaggcaccgaacccagaaacgtttgttgtgatagatgggacacccatgacggtacattctgctggcgtgtacccccatggttcgtaataggatggaaaaacacccaagtgacagccgcgaacaaactcgtcataatccaaaccaaggatagggttattggcgtttaagaattcaggatggaaaatcacttttacacgatcactcgaatcattgaataatctaacatgtctaatttggtttaaaattggatcgttagcatcatcgcacatgttatgtgtgactaccggaggcaattccccgtaaggtcttctcagcgccaatacccttttcttcagcaaaaccttttcagaactcttcaacagctcatctaaattagtgggcaactctgattctaggccattatgagggtatctcatcgtatgctcgaaaattctcttcccaatggatgcggtgacctcattaacagtattttccaaagattttacaatggcttggcttttcagtgcctccacagtgaaggaattggttttggcaggcatgatcaaaaacgctaccaccgtcttcttggatccagaaaccttcaatctgtaattgagacgagccaatgattcaatgaacatgtcagcacctttgtttttgtattcatatctaccagcgataaagaaataaactgtgttgtctagatcgaaatcaaaacaaccatggaaatggcctctgacgaaatcattaattttgtcctttttcagggcatgcagattttgaaattcatgtactgcttgaaacttaacaacgttcaaaccattgggcaaaatgccatccggtttcctcttcaacaaatgctccgcttctaatgcagtgatttgcgacacagtcgtaaaaacatcggcagtatgagccgcagcgcgctcaatgcagtacctatgatatatgcctctcttaccagcttcttggtccacatcaaaatactgtagattgttataaaaatctacatcaccagcggcacacaagtatctacccaataaagttgcgtgcgtggtgaaaatcgttacaacatcaattcttttctttctacacaatggcagggctacaccagctagccattcatggaaatggccaatgatggcatggctactgtccagttttgaaacttctcccaaaaaccacacaacaacataacccaacaatatggcatcgtttgtttcgtgatcatgctctggtgatggaattccgacgagagaccataggtcagccttccattcgttcaaaaagtgtcttacagaatccagctcaaataaaatgacacgtggtgctccctcaatcaaccagttaccgtagacaaagttcacacccttttcccgcatggacatcaaagttttttggatcggtaacagctcttcaggaaagatactttcatcttcccagtcaagtttttcaacctcactttcataagtcgccttgttcaaaggtccaagcagcgtatagttgtctccgtattgtgccacagtgactggagccttggacttcaagacagagtaaataccaccaaccctgttagttacttctgttgctacttcgaacagtagatgattttgtaagtcacgagccatacttcgctgtgatgctgcgtctgagtttattttctttttcttcacaggtttccaggctgtgctaactagtatatttggagtttagatatatagatataagtcaatgaaaaaaaaagtggaaggtaataagaagaaccgttgcgggaagaaaagaaggagtttatgtttatatacaccggtgtaggctgtgcgttggtgtgaacacttcctgttgctgttgctgttgaagccgtctccgcatgcaactgtagtcatacagcctcttgtctgcccttattcaattgaccagctaacaatagcttcgctttctttctgaaaaatcctccaaggggtattacttgtggggggttccaggaacccataggccggggcatgtttcacgggaagttctgtggcaggaaatggtccctgagtagccgcgcaggtggcttttgcctttgccgtaccgatcgggaaattgtgcccctgaaagattccgtttacggcgcttctgtgcaacctctttgggcaagctttgctcctgtcaatagagcaattatttgacaaggtttcttttaccttgttttatgtgggttaaacgtgggaggagaactataaatcacatgtgctgtcaagagattatgttagttacgtagcgcgcttaagctttcttaaatagtatcgtaaatgagttcccgcaatttgtagtcttcgttagcttcttctatttcttcccagttcccgattaagtcattgtgtcctctgaccacacctggaagactcctacccttgctgaaagtcttccaaacttttctcgcttcatcatctgtgccaagatctctgtaggtgaacgggattcggttggccgtcaggattgtgcttaagcgatttgttctggggatcatatggaaaccgcctccggctagtgacgtgtatatatatacaggttccttttcattcagcttccggatctcgctagtcgttattacgtcttgtggcttgtcattgtttttcttggattgctcagtagtttgagttgtggagtctttcgcatctagtgattggagtagagcgtttagttcagaatcatcaacaatttttagttgctctaaaaactcattcgtttcgtccaaaatatctttgaagatgtcatctgcacttgctttcttgggattttcccttgtactttgatcttcaaatccattttcgtcattgtttggggcttctttactgattgactctgtttcattgaagtctaactgggatacctcctcttcttcttgcttaatttcattcttttcctccgtgatgttttcttccactacaagatcaggaagagaagtttctttctctgtttcttctacttccaattccttgtcttctcctttattatcctttatatcttgtttttccaattctggcaattcgactgtcctttgaaattcgtctgaaatgttgatatcgtcgatctcttgatctccggtgacatctttgagcgcctcagcaatcttagaattttccatattctcgtcttcttttgtcacggcttccgcatccttttttgaaacttctgcctccgtacatgttccatcctctattggagtctcagcaggttccgaacattttgtttcgatgtcttcttttgaagttgcagcaacttccacatcttcattttctttattcagttcagcagtgacttctgcctcttttggagcgtcaagatttccaagctctgcctttaccttgataaattcagttttttcggaattctccacttctgcatcttcctcggtgtcaacttccacatcttcattttctttattcagttcagcagtgacttctgcctcttttggagcgtcaagattttcaagctctgcctttaccttgataaattcagttttttcggaattctccacttctgcatcttcctcggtgtccttcttgacagattcgctgctaggttctatatatttttcggcagttccaacatcacttgcttttgaattttcgctcgcagcctcagtagcttcaccatgttcatgatttgtatctttgccggtgattttatcgccttcttgtgtaatttcaaagcgtttgggtttttcttcttctttgaaactagtagtagatcctacatctcccatatccttttgtgtagtttcagcttgttctgttgaaatttgaacgcgctgggatttgggatcttcttcttcggaattctcaatggttgttgcaatttctggctttacatcttcatcgggaactctaacatcttcctttagaacctcaggatctctttcgttgatttgaagatcttctggtcttccggaggtacaacgcttaactacttttggagactcaggagtcttcgatttctcaacctctacaccttctgcactttctcttgctgtttcatcaacctctttttttgctttctcgttggaaagctcagcagtcccctcttgcttctttttcatgtcttcactgatagactcagcacctctcattgctattttatcatctttcatggccttaacaggttcatccagcttgacttgttccccttcttgatcttctttggcaacctcgagatcttcaggtattatatttttttccacagcctcaacaatctctacatcatccctaggcgcgtcaggtatatcgatttctccgacaacttccgtaggcttgttttcctgagtaggtgcttcagcttcatcttcaagaacaaggttatctttagaaatttttgcagagtttgcgcttccctctatttcaataatggaagatttttctcccgcttctgactgcttttcatctccccccataatttcctctccttttgatgtagattcttcttcggtaccggacacttcattatttcttacagcttcttgctccccggttacattttcttttttaacttttgaaaaagtcgaattttcttcttcttcttcttcttcttcttcttctttttcaacttctacagatatatcgttagtaccgtgttgtagatttttttcattgtcactaatgcgctttgttggtcccatcgtttcgtcatcataagtctctcgctcagtttctggagggatgatactatcactaccagctgcgttaaaattatggctcatgttattctcatgattaacagataattctttcctacatttttcgtcttctttatccttctgttcaaaaacatggtcttctttcccgatttctgtttctttctgattttttgcaagaactgaaggacttattccgtctctatcactttcagtctgctgcttttccccagctttcaaatgttttgattcgttctctttgaaattaaacccattcttagttaaactttcactttcaacatccttagtagacgcttgcccattttcatcacctgcctccaaaccgtgcggctctagttggtgtttaaaagaagctgcatttccctcattaacatttaagatctcattctcttctcgaggtaaggtatgttctgccttttcctcgttgatattgttctcggactttgaggaagtttcgtcaacattatctttgttaggcacatctatgtcgaaggttttgtcactagattcatttctggttctgatatccattttttcgacattaacaggctcatcttggacaatatttactttgatatcctcgttctttgaaccatcttcctgtaggtactcttcaatgcctactagtatggaatctaaagttgactgttttgacaaatcagtagtatctgcaggatttgaagaattacgacctcttctattcgtggtttttttctttttgtttttttttcttctcgtaattgggctattgccaacctcaattcctgtggattctttgattggtggtacattttctgtgccttccgctacattgttagtagaagtttctttgataactacattgacgtctattgggatctgtgtgggagattctgtagcgtcatttattgtatctgtggctatctctattacgtcgtcttttctttccaaatcatgagagattgcatcccgtgtggaagcttcctcggtttcaccaacagaactggaaagttttacaatagtatctctgtcacgattcgcctttatttgtccctggtttttctttttatgacctttcaatttagaagatttcctttgagatgataattcctgtgcaaaattctcagtggcatttatcgcttcatctaagtcactttctgtaagttgatctcgactttctataatatcattcgtacttggtaagggaagatctgtagcaagtgtcgaatacgaatctccagcactagttaccgatgggggttgaacattgtgttcctgattttctacagtcaaagattctaccatgtcactctttatttaatccagagtaatcaagcacaccagtacaataattgctaacaggtttaaaaagagaaagtgttctggaataaaaccacttgcttatatgcgaagtgactacgaaatattaagggaaaatatacgacaatttcgtgttcagaaacttaacaaatattttcatcttgtctgttatattctcggaagctttaggataaatttatccttaaaaaaaggactgcgcaagcccggaatcgaaccgggggcccaacgatggcaacgttggattttaccactaaaccacttgcgcttattggaagtgttcgtgttctaataaggtcacaacagctccaacattaaccagaaatacctgtaaatagccccgccacgaggcaacaattgtctctgtattcttatctttctcaataagcacttattagttagtttacatccgagttcttgagcactccccacctttttagtaggtctgaagtcttgtttacaacagcgggcacctcaagattgaaaggagttgagagttagaatatataattttgaaattaaatttgaaaatgatgcgattaccaccggcaagtattcaaaacaaaataagacgagggagcttcataaaaattaggtcgtatatgttgaaatgagaggatttagtacattctgtattcatcatattatagcctttaccaacaatgaaactccagtaattatcaaattattctcccaattctcaccgaacatgcggcaacgttaggtacggatcgcggaaaacactttattttgtgcagaggtactgtcatgaatactatgtcaataaaaaaagtatcgcattatcaccacgcctatataacataatctaaactattcgtgagggtacagaaatccattgaaatgaattgatagttctacacgatatcgctgtcattttattgtacgtttcaagttttactaaataaaaatgacatctgaaacagattaagtttttttgtaacttgtgcccgttgaaataggaattaactgttataattgacaatattcatgtcaacactatatagtaatatataataaagaaggtaacttaaatggcgataggcggtcaacaagtctagggaatcagaaatgcaagaatgaataacgtaataggatagcgaaggaacatatcaaaaacaagggaaaaaaaaattggttctatatctagatatatctagaatttttggactggttttatctcaatttccacctatctttatgtattatctttcgaccgtcttatcttttaatatggtggcaggaataccagtcagacaatgattggatcttgtctcgggttgtttgttatcacgtaagcaccacagtccgctccgtaggaaaagaaaaatagccgccgagccacgggagcaaatgagtgaagaatatgcgcaacgttttggtacatatacaaaaaaatgtagaaaagaagctaaagagattgacgttacgtacatatgtatgagtgggtaggtgtggacgacactagggaggctttacttctctccaaacatgtgaagctggttatagatgtccttcttaaagtcctcgtacttaaaagacgactttctacgcgtgcccaactgtggaggagagccgtgtgggactcttgcgctgttaccattgctgttgttgtcaaggtacgagtttttgaaaatgggtctgttgccagcacgagaacagatcggtgtatgggagatggagtcacccatatccacgccagcgtggctcaggtcagagtcgttagtggtcctgtattgcatattgtggatagtattctggaaatccatgggtccgctactcctacgttcggctcccggggcgtgctccccgatactgctttcgcgttcccgggcttgttccctggaatttagtgcgtccatataattggtagaccgccgtctaatcatggggactggcttgtctacgctttgagcgggagcgcttggacccgggaggttgaatgtagaaacactaggtgtttcctgtgcacagggcggttcgtcgatgttgaggaagtcctgtgatctttcaaatgtgggtgacgtgctcacttggggcgtgttcaagtggggatctgtcatgagggtgagtgtatgcgtgtgtgtgtgtgttgcgtagatgtgtgatttactatgtgttatgtagctgctctcatcgctgctgatagtagatctctcgcgcaaaaattactcaggcaaacctttactatacctacatatatatatatatatatgtatatgtatgtgtgcaagcttttcagagtggtgcactgacattgaccgggccactcattccaccccacatcccccagatcagggggagatgttaacgaaaggaaacaggggatttatcactggttacgggagcgtagtgactgtactacaaattcgcacacaagcagcgcccagtgacgagtctccgcggcgtctaagtgccggaagtcatcatccacggtgtgccatgtacttgggaatggtagcgggattgcatgtaatacgggtactccggcggccaggaatggcgtgtggtcgtctccgatgaccgaatgcccgagccctaaaaatcgatagtccgtggggtccagatgtttgcgttgacgcgcgacttcggcggctaatgccgattcgccgttgatttcatctccacgtcgaaataacaagtcatcctctattcgattgagcagctgatattcttgatgtgtctctgcatagtagctgggcactagcggctcctcttcgccacttcctaaaagatccagaagaaataataggcgaattcttgtcatcgtgccgtcagcaagccattgggcggctaatcggcgtgctccataaatcgagtcctcggggccccactcttcaatggcctcctctccatcaaagaatacgatctttacacccaaggtagaattcgatactacagtgttcgactctaagtcattgtactctttcgtgcgctcgtggcacgcgatgtgcgttaggaactgggccgtatatagcagcgcggcacacgaggcggcactgtcgatagcgcccaccatccccgtgggcgctatcttggtatcataatgagcagcgagcactaagtactcgctcgcattgttttgtaatgtcataacaaggttattgaagcggtaaccgttctcctcaaaggcttgcgtctcaacggcccattctcccgccagcgtattgttgaagtgctcgatgatgaagcgctggatctcgcgcgagccttccgatccgggtacgcgcgttctgttaaaaggcaacagcaggttcttggtacttttgttccaaccgctgtctgggttgatagcttcgttcagatgcgctgcatggtactgctcatatgacaactcccacccagttaccctatgcacctgaaatagcaccaacaggtacgctagaccaattagtcgcaaaggcaatacgtacttcattcccatgcttacgaccttttcagtctttttatttcttttctgttgactctctctaactctccctctccccctcttcttcccatgaaatgtatcacaagccgtcttattcctttgcttcttatattcttatgttccttccttcgtctcgcctcgaaggcaacgcaaacgcaatgtacttcttgacgaacgcgaaaaccatatggaaagtaaataaagggccaaacaaaaaactatttcgaatagcaaggtagcttccatcctgtacatgcaagaccgtcacacagcatgtcatcggaagaaccccatgcatctatatcctttccagatggctcacatgtccggtcgtcctccactggtacttcatctgtgaacacaatcgatgctaccttatccagaccgaactatattaagaaaccgtccctgcacattatgtcgacatctacgacgtcgactacgacggatctagtgacaaacccaattctgagcaatatctccgtgccaaaaataagcccccccacatcatcctcgatagcaacagcgacatcaacaagtcacgtgaccggcactgcgtcgcattcgaacattaaagctaatgctaacactagtaccagcgtgaataagaaaaatttgccgccaacaactagtgggaggataccctctagcaccatcaagagatatccgagtcgctataagccttctcactcgctgcagctgcccattaagaacgactccaactttaaacgatctagcatatatgcctccaaatccactgttactgctatccccattaggaacaatcggccaatttccatgcagaattcctatgcgcgcactcctgacagcgatcatgacgacgttggcgatgaagtgtcttcgataaagagtgcctcttcttcgttgaccgcatccctgtccaagagtttcctgttcgcattttataacaaccgcaagaaggacaagaccagtaacaatggtgtcctctcaaaggaatattggatgaaggacgagagttctaaagaatgtttcagttgtggtaaaacgtttaacactttcagaaggaaacaccactgcaggatatgcggccaaattttttgcagcagttgcactctcttgatagatggtgatcgattcggctgtcatgccaagatgcgagtatgttacaattgttatgagcatgcagacacatacgaggactccagtgatgaagagaatgattctacaatgcaattgaatgagccaaggtctcgctctcgctctcgttcttccaataccaatccatattctcattcacattcgcatttgcatctcatttcacaggacaaccataacggtaccgatctccatgatccagtagcagcaacggataaccctcaacagcagaatgaggtctacctattaaatgacgatgacgtacaaagtataatgacctcaggtgaagattctaaattgttcatttctacacccccaccaccaccgaagatggccatcccagcaacaaagcaaggcggatcgctggaaatctcattcgattcggaaaacgatagggctttgcattatcaagatgacaaccccggtcgccatcatcacctcgattccgtgcccacaaggtacactatcagagatatggacaatatatcacattacgataccaactctaattccactttgaggccacattataacaccaataacagcactattaccatcaacaacctcaacaacactacttccaacaacagcaactataacaataccaatagcaacagcaacatcaataatcctgcgcattccttaagaaggtctattttccattatgtaagcagcaatagtgttaacaaggacagtaacaatagctctgcaacacccgcttcgtctgcacagtcttcttccatactggatcctgccaatcgtattatcgggaattatgctcatagaaattacaagtttaaattcaactacaattccaaaggtccttcgcaacaaaatgacacggcaaatggaaataatgataataataataataataataataataataataataataataataacagtgccagcggtattgctgacaacaataacattccctcaaacgacaatggcacgacgttcactctagataagaagaaaagaaacccactgacaaaatctaaatctacgtccgcttacctagaatatcctctaaacgaggaagactcttctgaggacgaaggttccatgtccatatattctgtattgaatgatgaccataaaactgacaatccaattagatcaatgaggaactccacaaaatcttttcaacgagcgcaagcttcactacagcggatgaggtttagaaggaaaagtaaaagcaagcattttcccaacaattcgaaaagttccatttatagagacttaaatttcttgaccaatagtactcccaatttactttctgtagtaagcgacgataatctatacgacgattcttctcctttgcaagacaaggcctcttcatccgctgcaagcagactcactgacagaaaattcagcaatagcagtggcagcaataataatagcaatagtaatagcaatatcaacaccgatccttggaagagaatcgctagtatatcgggattcaaactgaaaaaggaaaaaaagagagaattaaatgaagtctctcttttacatatgcatgccctattaaaacaattattgaatgatcaagaaatttccaatcttcaagaatggataacccttctagatggcgctttgcgtaaagttttaaggaccatcctgaacgcgagggatttgaacacattagattttagacaaacttacgttaagataaaaagaattagtggtggatctcctcaaaattcagaatatatcgacggggttgtcttttcgaaagcattgccgtcgaaaacaatgccacggcatttgaaaaacccaaggatactattaatcatgtttccactggagtaccaaaagaacaataaccactttctaagtatagagtccgtctttaggcaagagcgcgaatatttggataaacttgtttcgagattaaagtcattacatcctgatattatatacgtcggcgccaatgttagtgggtacgcgttagaactattaaatgactcaggcattgtcgtacagtttaatatgaaaccacaagtcattgaaagaattgccaagctaacagaagcagatattgccatttctgtggataagttggctacgaatattaagatgggtgaatgtgaaacttttgaagttaaaagctacatttatggaaacatcagtaaaacatatacatttcttcggggctgtaacccagaacttggtggaacaattttgttaagaggtgatagtcttgaaaacttgagaaaaatcaaacaagtctctgaatttatggtctacgcaattttttcattgaagttggaaagttcattttttaacgataatttcatacaactttctacagatgtttatttgaagagagctgaatccaaaaaactgcaagttttcgaaggttattttgcagatttcttgatcaaattcaataacaggattttgactgtatcaccaacggtagatttccccattccctttttattggaaaaagccagaggcttggaaaagaagctcatagaaaggatcaatcaatatgaaagcgaatctgatttagatcggcaaacgcaactaaatatgcttcaaggcttagaatcgactatcactaagaaacacttaggaaatttaataaaattcctgcatgaaatggaaattgaaaatttagagcttgagtttcagaagagaagtcgtcaatgggaggtttcatattcatcatcacagaacttacttggtacgggctcacaccagtctataacagttctctactcaatggtttcaacaaagactgccacaccttgcgttggccctcaaattgttactattgactatttttgggacagtgatatttccattggtcagtttatcgagaacgtcgtgggaactgccaggtatccctgccaacaaggctgtaatggtctgtatttggatcattatagaagctatgttcatgggtcaggaaaagtagacgttttaatcgaaaaattccaaactagattaccaaaattaaaagatattatcctcacgtggagttattgtaaaaaatgtgggacatctactccgattttacaaattagcgaaaaaacctggaatcattctttcggtaaatatttagaagtcatgttttggagttacaaagatagcgtgacaggaattgggaaatgtcctcatgatttcactaaagatcatgtcaaatactttggttacaatgatttagtggttcgactagaatattctgatttagaagttcatgaattgataaccccaccacgcaaaataaaatggaaacctcatatcgacatcaaactgaaggtggaactatactataagattctggaaaagatcaataatttctatgggagtgtcctaagtcggttggaacgtattaaattggatagtatgactaaagataaagttcttagtggacaagctaaaattatcgaattgaagagcaatgctacagaggagcaaaaattaatgttgcaagacctggatactttttacgcagatagtccttgcgatcaacatttaccattgaacctggttatcaaatctctatacgataaggctgtaaattggaactctacatttgcgatatttgcaaaaagctatttgccttctgaaactgatattagtcgtatcacggccaagcagctgaaaaaactgttttacgattcttcaagaaaagacagcgaagacaaaaaatcacttcatgatgaaaaggcgaagacgaggaaaccagaaaagaacgaattaccgttagagggattgaaagatgtcgaaaagccgaaaattgatagcaagaatacgacagagaatcgtgacagaacgaacgaaccacagaatgccgtgacgataaccacttttaaagacgacactccaattattccaacaagtggtactagtcacttgacagttacaccttctgcatcgtcggtttcttcttctttgacccctcaaaccgaagaacgtccgccaataagcagaagtggaacaggtatatctatgactcatgataaaagcactagacctaacataagaaaaatgagtagtgatagtagtttatgtggactagcatcacttgctaatgaatatagtaaaaataataaggtgagtaagctagctacatttttcgatcaaatgcattttgatgccctgtcgaaagaatttgaactggaacgtgaaagggaaagattacaacttaataaggataaataccaagccatacgattacaaacatccacaccaattgtggaaatttataaaaatgtcaaagacgcagttgatgaaccgcttcactctagaagttcaggcaataatttgtcatctgcgaatgttaagactttggaggcacctgtgggagaacattcccgggccaataattgtaatcctcctaatttagatcaaaacttggaaactgaattagaaaattccattagccaatggggagaaaacattttgaacccctctggaaagaccaccgcaagtactcatttaaattctaagccagtagtaaaggaaacttcagaaaatccaaagtcaatagttagagaatcagataattcaaagtcggagccgcttccacctgtaataacaacaacaactgtcaataaggtagaatccactccacaacctgaaaaatcattattgatgaaaaccttgagcaacttttgggcagatcgatctgcgtatttgtggaaaccccttgtttatccaacctgtccttcggaacacatttttactgatagtgacgttataatccgcgaagatgaaccaagttccttgatcgcattttgcttaagtacttctgactatagaaataaaatgatgaacttgaatgtccagcaacaacagcagcagcaaacagcagaagctgctcctgccaaaacaggaggaaacagtggaggaactacgcaaaccggggatccttctgttaacatttctccctcagtttctacaacttctcataataaggggagggactcagaaatttcatccttagtaaccaccaaagagggcttgttgaacacccctcccattgaaggcgcccgagataggaccccacaagaatcacaaacgcattcccaagcaaatttagatactcttcaagaattagagaaaattatgacaaaaaaaacagccacacacttgagatatcaatttgaggagggtttaacggtaatgtcatgtaaaattttcttcacagaacattttgacgtgtttagaaagatttgtgattgtcaagaaaacttcattcaaagtttgtcaagatgtgttaaatgggattccaatggggggaaaagtgggagcgggtttttaaagactttggatgatagatttattataaaggagctgtcacacgcagaactggaagccttcataaaatttgcaccaagttattttgaatacatggcacaagcaatgttccatgatttgcccacgactttggctaaagtatttgggttttatcaaattcaagtaaaaagctctatttcaagttccaaaagttataaaatggacgttatcattatggagaacttattttatgagaagaaaacaacaagaatatttgatttgaagggttccatgagaaatagacatgtcgaacaaacaggtaaagctaatgaagtgttgttggatgaaaatatggtagagtatatttacgaatcacctattcatgttcgcgaatatgacaagaaacttttaagagcttctgtttggaacgacacattatttttggccaaaatgaatgtgatggattattccttagtcattggtattgacaatgaagggtatactttgacagtaggaatcattgatttcattcgaacgtttacatgggacaaaaaactagaaagttgggtcaaagagaaaggcctagtagggggggccagtgtgatcaagcagcctaccgttgttacaccaagacaatataaaaaacgttttagggaagcaatggagaggtatattttgatggttcctgatccgtggtattgggaaggaaattaatacataaacgtgtacaagttatattctgtaacttttttttatacactatcacgcacattagggttctttaactttcagtaccttagtagttatcaactatgaaaaggtggttcaatgaatgttacgaaaggtttattatagaaggataagaagcaaaaatttaaaaaagaaatgcgtcacagacaggattcgaacctgcgcaggtaaaacccaatgcctaattgcttttctgaggaaatagcagggcatcgccttaaccactcggccactgggacagaatctcttggtttgttcaatgaagtaaactattttgttgtaaacataatgggtatgtttaacggcgagagaaaactatgcgaaatttggtataattgttgtgtttccattgttgttaaaggcattaacactaagtttacagaacatactagaagttgttttcggcaacataggaatctacaaaaggggatggataattctacataataatattattatttcccctttcattgttgacataatgttataaattcgtactctatgttgctggtgtgcttatgaacgctacaatcaattttttcatgcatacttgaggtaataagatgtcgatacttttatggtgtttatgaacatggcaatacccgttaccactcgtgttgggtgtaggtacagcaacactagattccgaatcacccccgtcattgccaccatactactgtagcgatatggcgagtgtgtatcattgttgttttgtcgttggccatcttcaatataatcaatatgaaagccaatcatgcattttgaaaagatagtctcgcggtcggtgttgaggaacttttcattgcctacgtcgaaatcaaattttgaaaagctgtggctagagttaaacctaaaacagtcattactattcgaaaaatttgacgcttacgttcaggttctgaatcaatccctttcctctacacttaagtttggttgtggtttatgttactactacatcgctcggttgcaaacagacgtgtatagcttttaggaatactgttgttcaagatagagcatttgcataccttatccgaggttcactatcgctgctacattggcataaaattgaattgttaaggacggccaatactatacttgctgccacattggtttaattcgttcactatgattatggttgcaacagggcagtttctatcgtgatcattcgccacatacttaaaaagataaaaaaagttaaacgactagactaggagttatgcagtatgagctgcagctccgcaactacaactagattaaatactgggggggcaaaaagataaagtgagtatcttgagcaggagttcccttgacatattaatctgtaaatttgtttttttactgaatttactacttaatagtaaagatgtggtgctattctcactttttattaatttttgtttccttcgtgacttcttttgcacataagctcccagctaataactcaacgactaatggaggtaccgacggaatagctgtaccagttatagaaactactattgattcagggatgtattctgagaacggtactgatttgatgacacccgaagatcttcctgatttgctatcagatggtatagtattatcttttgctaatactacagaaacgggctcggattcggactccacgttaattgacagtgaagatcttcggagatgtatagatatgccggaccgctcatgctctgctcaacgaggcaatttgtgttcatacagtttttgggatattcctttcagtttcttgaatacagtccatgatatattcggcatgactaatatgggtaattgcgcagttatggctggtgataagggtgctttttattataaatactatcctgttgaacctaactgcaattcaactatacaccaaaagacgattgacgatgctttacaacaagcaactgaacaactgaatggtgactttaacaacatgtattttttccatgtcaaccgtggtggattgtggcagggtgatatgatggttggaactcgcgtctttacctggtttgctggcgccaagtgggctgaacataaaggttccatagaggcaggtttcacctcgtagtccctcattgcaggaagagaaggcatagcaacacagtatgataaagcaatgcatttggtttataattgttaataaaaaaaaaaataatggataattacattgaggggaatttttccgtatgtatatgataacgtatacatacgtatgcagcttaatccacactgagtttttacttgtaaacgctaaggtcaaagggcagataatggattccagactaggagtgcatataaatggacacttggattcttcattagatggtcactgtatcagatcttagcaatttcttttgtaggattggtataaatgaaaagtatgcatgtacccatgcgatatgatattaatatgtatttctcattatttatgtagttttctaacaatatatggtgatatgaatggccaccattattctgtttaatatcaagtaatggacaaaacctttcttttcctgattgatgtagttcactgtaaccttcttgttcgtgggcacacttacttagatatttccttgcgcagttattatactgaatttagagaagcgacgcaatatttctacgtgatatctataaaaaagaatacttcacttatgcaagcatcgcctggctgtaatctttgcttcagaccatctgacacatgtacacagtaacacatagcgagctatgaaaagatgatggtgagttcgtggtatggctacgtagaagatatgcgattcatgcactaccaccgcttaacgtagttatccgaatgcataaattagactagtatgtgacaacgctaaacatgcgttccccagaaccacctgcggttgttgagaggaataggttttgcgcttgtctatggacactttcttgaactcaatccaactgagcaatacttaacaatattgcgattacttgttcttacataaagagtaagaaatacttgcgaaataaacggtaatcaatcaaatttagggtcataagttgtattcgcacaatatgcataagcactgactcaagaaagaagatggttttcgaatggggagctagcaaaaagagtcacccctaagtataaaaactgaattacaaagctcttcgactactttctgcaagtaaatcattcggaagtgcgacaatataatgacaaaagacgataagttacttctattaattgaactttaagtatttggcttttattttttttttttcattttcttactcgcgcttttctttattaagggctttctcaattagatgttaataatgtcataaggcatcgttattccgctttatattggtaactcagcagtggtcattgccttcgttcacgaccctcccttattaatcagttagtaatagtgttccagttaactctgtatccttttctcttcggcctgacaatgtctgattcatcacctactatcaactttattaatttcaatcaaaccggaacgtgtatttcccttggaacgtcgaaaggtttcaaaatattcaattgtgagcccttcggaaaattttattcagaggacagtgggggctatgctatcgtcgagatgttgttctccacctcgttactagccctcgttgggataggcgatcaacctgcgctttcaccaaggagattgcgtataatcaacacaaaaaaacattctattatctgtgaggtgactttccctacttctattctgagtgtgaaaatgaataagtctcgattggtggtacttttacaagagcagatttatatttatgatatcaacaccatgagactattgcatactatagaaacaaaccctaacccacgtggccttatggctatgtctccttcggtagccaacagctatttagtgtatccatcaccaccaaaagttattaactccgaaattaaagctcatgccaccacaaacaatatcacattgtcagttggtggcaacacagagaccagtttcaagagagatcagcaagatgctggccatagtgacattagcgacttggatcagtattcgagctttactaagagggatgatgcggatccaacaagcagtaacggcggtaacagcagtataataaagaatggtgatgtgatcgtattcaacttggaaacattacagccaaccatggtcatcgaagctcataagggcgagattgctgcaatggcaattagttttgatgggacactaatggctaccgcctctgataaaggtactatcatcagggtctttgacattgaaacgggtgataagatctaccaattcaggagagggacgtacgcgacaagaatttactccatatcattcagtgaagatagccagtacttggcggttaccggctcttccaaaaccgtgcatatcttcaaattggggcattcaatgagcaacaataaactagacagcgatgatagcaacatggaagaagctgcagccgatgattcatcgctcgataccaccagtatcgatgcgctgagtgacgaggaaaacccgacaagactcgcaagagaaccatatgtggatgcatcaagaaagacaatgggtaggatgatacgttactcttctcaaaagctatcccgaagagctgccagaacattgggtcagattttccccatcaaagttacatcgttgttggaatcctcgcgccattttgcgtctttgaaacttcccgttgaaaccaattcccatgtaatgaccatatcaagtataggctctccaatagatatagacacatccgagtatccggaactcttcgaaactggcaattccgcaagtacagagtcctaccatgagcctgttatgaagatggtccccatcagggtcgtttcctcggatggatacctatacaactttgttatggacccggagagaggcggcgattgcttaatattgtcacagtattccatcttgatggattgatcacggaagtgtctcgcgctgccttccgtacgtcacaacgcatacacaatatagtttatataaactcctgcgtataatctatccttttgcataatattttcgtcaccattatcttgttgcggtgtttttatttaaaacaatagaactcgcctaaaggggaaattttcgatataaaaattcaaaaaaatggctttcatggatcgagtatttgtttgtcgaaaaaggatcactggagtgacgttactacgctacgaagcctccttccggcttagccctgttgattacgaatttggatcagttggtatttgattcctcggaagagttaacttcacgcgggtaaatcacttgtgatgcggtatattctctatacggctaatagatgaatcagggtgttttaaagtgcgtataaacccttttgctattttcgtttatataattggcgttgataaagagccaatatctattgttgctacatagaggcagctctcttagcaaaataaaaatacaaaaagttcgacatgggcttcagtagcggtaaatcaactaagaaaaagcctctgcttttcgatatcagacttaaaaatgttgacaacgatgtaatactcctcaaaggtcctccaaacgaggccccctcggtgcttttatctggttgcatcgttttatcgattaacgaacccatgcagatcaaaagcatatcattgagactttatgggaagatacaaatagacgtaccattagagaggccccaggacgctagttcttcgtcgttgtcttcatcgccgccaaagatcagaaagtacaacaaagttttttataattacgcatgggataatgttaacctcaaggagtatctgagtggtttaagagggcaatctggccttgcgggcagtagctcatcaagtaatatcttgggcactcgccaaagagctcagtccacaagttccttgaagtctttaaaggggtcctcctcaccctcttcatgtactttagataagggcaactacgattttccctttagtgctattttgcctggttcgttaccagagagcgtagaatctttgccaaattgcttcgtgacatatagcatggaatccgttattgaacgcagcaaaaattatagtgatttgatctgtaggaaaaatattagagttctgagaaccatttcacccgcagcagtggagttatcagaaactgtttgtgtagataactcatggcccgacaaagtggattattctatttcagtacccaacaaagccgtagctattggttcagccacccctataaatatttccattgtacctctttcgaaaggtttgaaattgggctcaatcaaagtcgtattatttgagaattatcaatattgtgaccccttccctccagtaatttctgaaaataggcaagtgacagaactaaatcttgaagatcccttgaacgagtcatctggagaatttaatggtaatggttgctttgtaaataaccccttttttcagcctgatcattcattccaagacaagtgggagattgataccatcctgcaaatcccgaacagcttatcaaactgtgtgcaagattgtgatgtccgctctaacattaaggttcgccataagctcaaatttttcatcatcctaattaacccagatggtcataaatctgagttaagagcgtccttaccgattcaactttttatttcaccatttgtggcactttcaataaaaccattgtcatcctcgaatttgtattcgctttttagcaccactaaccagaaagacgaaaactcatcacaagaagaggaagaggaatatctgttttctagatcagcatcagtcacagggttggaattattagcggatatgcgtagcggtggctctgttcctaccatttcagacttgatgacgcccccaaattatgaaatgcacgtatatgatcgtctttatagcggttctttcactcgcacggctgtggaaacgtctggaacatgtactcctttgggaagcgaatgttcgactgtcgaggatcagcaacaggatttagaagatttacgtatacggttgacaaaaattagaaatcaacgtgacaatctagggctaccaccgtctgcctcgtctgctgccgcttccagatcgctatctccattactaaacgttccagcaccagaggatggcacggagagaatcttacctcagagtgctcttggtcccaatagtggctctgtgccaggagtacatagtaacgtatcacctgttttactttcaagatccccagccccaagcgtgtcagcccatgaagtgttaccagtgccctcgggcttaaattatccagagactcaaaacctgaacaaggttccatcgtatggcaaggcaatgaaatatgatatcattggtgaggaccttcctccttcctacccttgtgcgatacaaaatgtgcaaccaagaaaacccagtagggtacattccaggaactcttcgacaacattgtcatcttctataccaactagctttcattcctctagttttatgagtagcactgcttcccctatttccataattaatggctctagaagtagttctagtggggtatctcttaatacacttaatgagttaacttcgaaaacttcgaataacccatccagtaatagtatgaaaaggtcaccaacaagacggagggctacttctttagctgggtttatgggaggttttctatcaaagggtaacaaacgatagtcgccgatattgtttcggctcgtgcattaagcttgtatagtttcatatagaaagtgatgtatatagcatttacgcactctaactggcattttaaagaaaaagggataaatgcaatgtttggcgtgcggcagtataagttcaaaaaaatccactgcattgttgaaaagagtcaggtcgatcctgctattggttttcagtttgagggatcctttgatttgctagatatcataagataaatggtccaccataaagtaattaaatcttgaaattaaattcttattccattagagacagagaaactattcattgtacattctccaaatgtggtgatataaacactacattcgctaaattacattatattatttcgagctttgtcttgtttatatttagttacgttgggatcaagttttaaaaaactagatctggagtgaccaaaaaaaaaatacccagcgtaaggtaaatattatggatatgctttggaagaaaagaattttgagacttacacattattcggcacagtaggtactagaaagcatagaatcacattcgcctttaaagacattcttttttcttgctccttctatggactgcgacacaatagttgtttttgtgtcgtaccgaagaaaaagccttgtgcagaaagcaaaaatagtacacttctagccttgattaccaagagttatgacaaaaatttgcagttcagagtataccttaaaaactgttcctaaggtcaaataaagaggaaaataatcaaactaattattcattaattgaacgaaccaataataacgagagaatcagtatcacaaaaaaaatttcaacctacaagaggaaacatgtattctatttcaaacaaaaaaccttctatactcagtatggttcccctgaatattttgaaaaaccaggatttgaaagtaaaaaaagatcaagaaaagaaaatatcatttaaccccgtagttactcctattaggccagacgactaccacgaaaaaacatccagatcgtcaagttcgagccattctgattcacctgaatttttgagaattaacaacaacaaatccggtcacaagaatggaaaattgaaaagttttgaaagtaaaaaactagttccgctattcattggtgacctccatgaaacagttactgaagaaactttaaaagggatcttcaaaaaatatccctcttttgtctctgctaaagtttgtcttgattcagtgacaaaaaaatcactgggccatggttacttaaattttgaagacaaagaagaagctgaaaaggctatggaagaattaaattacacgaaggttaatggtaaagaaattaggattatgccatcattgaggaatacaacgtttagaaagaatttcggcactaatgtctttttctctaatctacctctaaataatccattattaacaacaagagtattctatgatacgttttctagatatggtaaaattctatcatgcaaattagactctaggaaagatataggatttgtttactttgaggacgaaaaaactgcgagaaatgtgatcaaaatgtacaataataccagtttttttggtaagaaaattctatgtggaatacattttgataaagaggtcagaagtgttccaaattttgaaacacaaaaatcacgattagatgcggaaacaattattgaaaaagagcaatctttgaatgagaaacactccaaggggaatgataaggaatctaaaaatatttactcttcatcccaaaattctatattcatcaaaaaccttccaacaataactacaagggatgatattttaaatttcttcagtgaagtgggtccaattaagtcaatttatctatccaatgccactaaagttaaatatctttgggcatttgttacatataaaaatagcagtgactcagaaaaggcaattaaacgctacaataatttttatttcagaggtaaaaagcttttagtaaccagggcacaggataaagaagaaagagccaaatttatagaatctcaaaaaatatctacacttttcctggaaaatttaagcgctgtctgcaataaggaatttcttaaatatttatgtcaccaagaaaatattagaccgttcaagattcagatagatggatatgacgaaaattcttctacatattctgggttcatcaaattcaggaattttgaagatgctacgagaatatttaactttttgaataaccgtttagtaggaggaagcatcgtcacgacatcttgggaaagacaaaataatgcacctaaatatcatgatggttatggaatgcgcaatatacacacctcttctcatccacaaattaccccatattaccagtactcacatgcgaatagtttgaactccccacacatgagagatctttcgtcaatgaatagcagcacaagatcactaataaagaataaaaatttcaataagaaagttttggaaacattcgaaaagcaagtaagaagaggtatagatttcatgagatttccaagtgccactagagacgaaaatgtgcacggaatagctgagtatatattcgacacttattggaatcgcgatgtgttaatattggacaaatttttatcgttgctaaatagtagtccatatcatgaaggtgtattgcaaaaacaaattgaagaggctgcaagctcgttaggatttaaaagatgaatgtctctttgttaatttagctagagttttccttatttattttttttatttacactaattcaatctttttcgttatatttagatattattaaaaattattattatggaaaaaattcttaaaaggatagacagagggacgccgtctgctatatgatatgtatttaggtccgagtgctgataaactgtaaggcaaaaggtataagtgtaaatcaataacgtttctcgtattctttactctccttcaaattttttaaactagttcaacgtaatttgctgggaatataccttctctaccgttgactcttccggtccaccagtcattttgagaatctgattttttcaaaattgtgatcacgtcaccctttctgaatggtaaatctccggactcttctcctgcaaagctatataatgccacggcctttggagaagacgtggatggggatgttggagcagtgaatctgccctgactagtttgcggtgttgaagcggacgagattctagatttagaaaatctgttcgacaagtcatcgacttcacggtcttttgtcctatctcttccattcccgcgtctatacccggattcataatcatcatcataatcatcgtattcatcatcagcccaacgatttcttgaagaacgagcccttgactgagcagttcctgatcttctgtggctggcataataacttgaagctccagatgggtcatccaatttaccaccactaccgccactgttggtaggagccagtcttgaattccttgaatagccagtaccataatcatcatcgtcatcatcatcgtcgaacgtataacgagaaccgctttgggctcttctccttgtggatcttgtgttaggtctagtggaggaagcatctgtagaactgaatgaactaggaatgtcattatagtaatcgtcgtcgtcatagtaatcgtcttcgtcgtcatcgaaactgccacgaccaccgttggagggtctgtaattaaacgccctggactctaaaacacgaaacaatggatcaactgctggaggcggtcttatcctaccagacaaaatcattttcgcggtacaattgtcaccataaaattttctgttagcctctcttctttctataatagccgaaccttccacagaaacccctgcaaatagacctttactcttagaataggcaaaaactgcagccacaccaccggcggaggctgatgcagctgcttctgcacttctaccaagaggcccagcagaaacggagacgttaccacccaacgtgatggtcccaaattcagaaaacgacttaacagcatcctgagtatttaaaatgaaaacaaaatcagtcaattctataccaaccatcccaccggcaccagcacctgccatggcaatggcagatggagctgaccaagtaccatcctttaatcttgcgacaatcacaccagaaccagctctacctgaaaatagaaaacctgcttttaagatcgttatgatagccaaccctttagctcttttcaaaacgtctggaggaatgacttggtccgcaccaaaaacttggtttggtttgacaaaactagccaaaatcttcgctgcttttctttattaattgtttattactagttagtaaatgatgaacaaattaagggagaacttttttaaaggtttcccagccaaacccgtataaaacatactttgtctcactctttaaactccttggaataggattgttaatacccattgcgtgtgatacagcttttgtttttgatttctttgccacccgtgatccaaagccgttctagatttcttcgatagtttatactctttcatgttgaacttccagatgcggccgagtcggcgagcaaacagggtgctgctactaaacgaacaataaagaaagacaatttgggcacccaatataaaatgagcagtcaattcaatcaattcagtgtgaaatttttttcttggaaagatcattcacttctacacagctgtacatgagtttatatgacagtttttttttatgtacatccagttcaagataatcagattatatattggcccaaaagggatcattaacgaattgcgaaatgggtaatctctttacagttaacagattctctggtgattggctttcctcaaggtagcaaatatactctaattgtagcacgtctactatgtatttctttaccttgtcatagcacacacccacttgcgccacgccgtgtgcgtcatcacttagaacaaatctggatccacagtgcttcttgaccagattacataaggttttgctggggtacggctcctcgaggcgctttcttaatgcggacgtattgatttcaattgcgccgccataggagtctataaattgtaaatttcttacaactgcatcgtatatttctggccattcactgatgacgtccagtgaagctacaggaactccggtttcttcgttgcagttgcccgatttctggtttactagcatgtcattgggcaaaaataatttgtaaaggtcgaagtgacccacgaccaacggtttaatattgatcagcatttcgtactgtgattggaagtaagacaggagaaaatgtttcaaattatcattgaaggaatgcaatgaattgtaccattgttgttggtcgaaatcaatagggatcccgttgacgtgatggaccgaacccacacaaaacttcaaaatatcattattctccttcatgagtcgctttgcatattcgatatgagccatgtcacaactttcgatctccattcctataatgaatttagtccgcacatcgggtctatcagcataacgagtcttgatttcttgcgcatgactcatgaaattcttgaacgatgtttctagcttggttatgacttcctcaggattcttgcccaatgactgctcttcggggtatataaacttggcctcaattcttggtatgtgctctgtcaaacagtacgtgtgaaagttgaggttgaccacttgatcgaccacggaatccaaagggtccgtaccgtgggcactatagtcaccggagtgtgaatggtgtgagtgcatgacctcgaggatttttactgaattgtacgtatcaagaagtactaaaatgtgtttgaaagggaaagattgtacgggaaatggaaaatgtacatataatatccagtatcatttgagttgatagagattatctctatagatagagagatttgacaaaaaaaataaaaaaatttaaatggacgagtccggaatcgaaccggagacctctcccatgctaagggagcgcgctaccgactacgccacacgcccgaacgtttgttgaaatcttccaaacagaaatgatacaggtttactttacagcaagacattagtagtttcattagcttatcaacatgtatgaaaccggcaagattgaaagcttgattgcccttgacgagctactcaaatgtgtaaatatctgcacaatcagtttacactcatgtttccgcgcttttaccctccatctagattaaaatcttatatggattatttgggataaatagcatttagtaaatcaaattgataaaaaaaagaatagcatttaggtatgcagaatatactagaagctgtcctcactgatcctgaatccaaaaaagagaattctacgtaataatattatcacctcttcctccattttatatgctgtcattcattatcctattccattaccaatccttgcatttcagcctccattaaatccgatggttgtttctcaacttttatgccatcttcttatacccatataatgatatattagtaggaagaaacactaatcgatagatgataattatcatttacctacgcattcgtattatcgtattcgcagctagaggccagtgcaaccatatagatattgctattaacttcattgtagctaaagcaccctgggtgttaaggagaaacatcaataagagaatagtttgtagtattctgtgaaattttcggtgaccatggtcttcaaggagaattctttagtatattctatgtatctataactaatttccaaaaaatgacatgtcaatcactttccagagctataagatatattcaggtttatcccaaaaatatttacagagaaataacccttgcaaaaccttttggtacacgaacaggcccctttaaaagtttcttggcagtttttttcgtcttccttcttttccggccatagcatcgtttgcggatcgttcaaactcctattatccgatgagctacccaactgccctcccattaggtagtggttattagggcacttattgtctcttgtggtgttgtagtaatggttaatataattttcgagcaaatagagtgcaacttgcggttcgagttcaataagattaatatccctcaatgactcaggaggtccattccagggaatagaaagtagtgcagttgcatactgttcattagtaccgtctccatttttgcctctgagatttgatggcggaaaagcgacacatgaattgttgacctggagtgcgctcactgttacaattagtaaggccacggtaattgctactgcatagggcgtcatcaccttttcgaaatttgacactgctaatttggcgccagtatagagtttctttctcttgaatccaatgagatcattatcctagtatagagcttgtaagtccaagctgcacttaaatatacaacgatcagaaaaaactcgtatagtctgttgaaaatgcaacacgtatacctccggagaagtatctttggttttgatttgccgcgcagcctgtgtaaaatggcgcacacaatcacgttacttgaatctcagttcagaagtttctttcaacacagccaattgcatttagtctgctatgcttaatattgtagctactacgtggcaaacatagctgcccgaactactttatgcgtacgtgtccacagcaatttgtataacgactcaatcaaaattctctcaaacaccttcatgggaatctgtcgacaatgtaatcagatctcagcccaattgccagtatgtgttcatatcttattccgtggccgcccctccaaaaagcttcaaaatacactcaccaggcttacttcttgttgggagaagaaccgttatcgttcacttgataatattcctaccagtatgttgtcctatatggagtcatgagcatacatggtgcaaaattatggaattagcgcaatgagtttcaaacagcaatttgatctttttataaacactgaaatgccagaattgataatgtaataggaaaaaaaaatgaaaagattcaaaaccgaagataaaatgagattatttttttcttttatgtagaaacatcgattcgcttctgtgggttcccatatcctcgaggagaacttctaatatattctgtataattaatattatagcattaacaacggtataatctcagtcattatcccaaaattcacctattttcccatcataccgatctttgcgaatacttgagcatgtaaatcagagattctatgtaacagctgcccagaaaccagaaaacgtctcttaaccacttccattgttggcatgttgaaacctcctgccgccttgatcatccttcgacttagggaagaatcttaacaaatgaaatttaacgtcaacgcgtaatagaaaaaaagcctttcgcgtactgtaatcagtaataatacataaggagatgccagctacaacggacatcaacatatatctatgtttacatattagggttcaacagaatataaatcgttgcacaaaatgaaagctaggaaatcgcagagaaaagcgggcagtaaaccaaatcttatccagtctaaattgcaagttaataatggttcgaaatcgaataaaatagtcaagtgtgataaatgtgagatgtcatattcctcgacatcaatagaagatcgcgccatccacgagaaataccacactttacagctgcatggacgtaaatggtcgccgaattggggttctatagtatacacagagcgaaaccattcaaggacggtgcatctatcaagatcgacagggacaataacgccattgaactcctcacctttgaaaaaaagtagtccgtctattacccatcaggaggagaagattgtatatgtgagaccagataagtcgaatggtgaagtccgagccatgacggagataatgacactagtgaataacgagctgaatgcgccacacgatgagaatgtcatttggaacagtaccacagaagaaaaaggcaaagcgtttgtatacataagaaatgacagggcggtcggaataataattatagagaacctttatgggggcaatggtaaaacatctagtcgtggacgttggatggtttatgattctagaagattggtacagaatgtgtaccccgattttaagattggcatatcgagaatttgggtgtgcaggacagcaaggaagttgggtatcgcaaccaaattgattgacgttgcaagagaaaatattgtttacggtgaagttattcctaggtaccaggtagcatggtcgcaacccacagacagcggtggaaaactggctagcaaatacaacggcattatgcataaatcaggcaagttactattgccggtatacatatgactctttcgaaaagacagcgagaagggacactggaaaaatggcataaaacttttcaaggttattattagtaagtttttttattatatgatatatatatatataaaaatgaaataaattatttcttgatggagccacttatttttcttataccaccggcggcgcttgtagtccttctccctgacgttactctcctattcttgggcaatagttgtcttagtatggtatcatctgcggcattattgatgttcgttgcgctgggttcgttatcttccattcgggacgatgaagcagaggagatatcatttttcttgcgcgaaactttgggataatgattacttgtgccgttggtatcctgcatggattcgtcatctgagttgttgctttctattactaccttcctattcgcatgggaagttggattacgattattgttgatatcttctatagtattagaaccgttttggccctttctcggctgaccaggcgaagtctgtgggacggctgagctcttgaatgaattacttccattattcgccgtagaaggttggctcgaatttctggcactaagcgccccatgaccgttggatggcggcgtcatggttaaatctcttaattcaccttcaatgttattttgcgcaaccctcttgtcgtctttaagtttctttttttgtaagcggtattcttctaaacttattaagggatataagccgccaatggcctcactaggcttcaaagaaattctggttgtgtacttccattctctaaaatcattctggtgtaaatataaccaatgctgttgagggccaacgaccattcccggccttataaaccttaagaagccaatacactcgttagcggtaaatccatacgtgtatattaagtgagcaccaattaaacaaccagttctacctagcccagccttacagtgcacagcaattttacctccccttttaattatcgtttcagcagcaccaacaaagttttttacaatggaaagatcaggacatgtaccatcttcgaaaattagatccaaatgttgaatgccaatgtcttcaaaatgctttttattatataaatgagaattcaaccttaccactaattggacgttattgttggcgaaaaaattcagaactgacttaaacggctggttcaaatgtgaagatttggtagcgagatagccctttggatggtcctcttgtggtgacgcaaatgcaataaaatctggggtgagtacattgaagtctccaaactccacgtgttcgtatttctcgtaactctccaaattgaaggaatgcaaatcaataaggcctttttccttagccctccaaacgccataaaccacatcttgaattgtgatttcgaaatccgcattagaataaccggcatctctaaatggcatgaagggagggtctacttgcgccaacggctgaagcacttgatgcggagtccatgcctgaacgaggatcatataacagcaaagcatacatgcggcgttagcacgttgtctggtcgatgcagatgaatagaaaacaacggctttattggcattttctgggtcattcaagatttcatggaaaataacggcaaaacgatatagatgtccaatgttcatgggaccgaaatccaaatggaaactgttgtaaaagattgcgtcctccacggtaaaaaacaccagctcatcagtatcttccggcgtgtaatcatatgcaccgagatatactctgcctcgcaggaactcgatcgtgttgtcgaggtatacactcctacgcattttttttttttttttataagcgtactttgtagtcccagcctctgtgcaattgtttcgtattatacctcgaacgaatcggaaatatttggtacattattgtttcaatttcaatttgtttacctttgaaccaagtgaagaaaaacttatggtgctaaaagtacattccccgttgaaagtgatacagctttcttgattgacacaatagcaatggccttcaaatgcatatctctactatcggctaaaaaacgaatgactcacgttatcaggctcatagcttgtgtgtgtgtgtgtgtgtgtgtgtgtgtgtgtgtgtgtgtgtgtgtgtgtgtgtgtgtgtgattgttgttctagtcgcttgctttataaagtaacgacactttctggtgccaatatgtgaaaacgcattacagaaaaaaacagttgtattctactaaaaacacatcagtagtcacagaagtcacagaagtcacgtatataagctagtggcaatcataactaacacaggtgtattaatgaaaaaataaagccaaaaaaatttcagaaaaaaatatctcccgggggcgagtcgaacgcccgatctcaagatttcgtagtggtaaattacagtcttgcgccttaaaccaacttggctaccgagagtcgtttttgttgattactttgctatataaagattcctttatcattatttcatgaggcgcacttttgattttcacacctttttcaagcggaggagttattcgtcttattaacattaccattacagtagtcatcaatgattaccttatcagcactgaaaagatacccgtaaaatttagcacacgcacactcacacatacataggtacgaaatacacaactgataggcgttcatgcactctcatagacaaaagtggggccgccagacggatatagcgagggtgctcgacgatatagaacacgacctctatctaccgcaacggctatcactcgatggtgcaactggtactgacgaatcacatgtgcaatacggtatagtcaaagactgctctgtgcttacgtgtggctgctgtatatctgaatcgctattcaatgatttatgcagggaaacttcgaacaagcaaactgcgtgtcccatctgtcagcgagaaaatgttcgactactttcagccatcaagccgctgcgagatttggctcgtcagattgacttcttcagaagtactaccggacagggcgaaagcgaaagcgatgagctccccgctatagtaaagacttcaccatcatcatcatcactatcgctaacgccatcgcgctcttcctccactgctgggctagaagctgataacaagacactatcagaccctacagttaaggagaaatcatcactgctcgaactcttccatattgtggcttcgaagatgcataatgcgaatacagaggtagggtcggaccacccactcacgactggcaccacccgtgatcaagaagaacacaccactaaggagaattactcaagcagcttactcgagcccaactatgacgaccacgcgaactggaaaatcctggataatgcctcgaacacaagaactgtgccgatagataacaacttctctttgatgtctacggacgttacaataccttccacagcaaactaccaaacaaatagtgcacatgatctggacgaagaaaaggagtacttttttgccaactgtttccccatgtacagaaaaaaatttcagttcaacacacaccccaaattcctagggacgaaatccaaattattcatcaaccaaagcatttctcccgattgcaccaaatttgctctaattactgaacacaagtgggaaatttattcgattaatccgaaggacaactctcctcaactagtatcatgtggcaagtctagtggagaatatggtcccaacttcaaccaactaacagagcaatcgtcatcttcactctccactacttctcaagcgtcaaaaaagaaaaagaaaaactggagccaacgtttttgcaaactttccaatgatttcttgataatatcgggttcgcaaaacattcttaatgtacacgacatacaccaaaacggcaaactcatctatacctacgtgtcgagattccccatccgatgcatagacatagatccaaggtcgcagataatagcctacggaatcaccggaaaggatagacatacaggcgcggaacaagcattagtcgtgatccaacaaattaccagaaataaagtgactttggagcccgagttccccccaccaatcaccataacacttccatacagagatcccatcaataccatacaactttcgcacgacgccaagtatctgacatgttcgaccgcgctagagtcgcggttcttgatcatatctttgcagaaaataaacgaaccaagactgataatgaaaagtgttcggtccatagacacttccttagaatctgaaggtatcactgacacaaaacttttcccaggaaatccaaatctgatgtgtatcacatcaacagcattcaattcatctccactggtcataaacaccaaaatcacccaaattaacggtgtacggaccgtggcacaaccatccatgcttataagggtagatgagattggatgcaagattcacaagtgcgaaatatcaccaagaaacgacgcaattgccttcctcgaccgcaacggatcagtttacatcatgtgtgcccccaccatgatggacaacaacgaaaaaagaaggacaatcctcgttgaaaccgtggcaaatgcctacagggcttatgaatcagctactttgcggtttaacccagagggcaacaagctttatattctcgacagaaaggggactttctttgtggaagactttgcatatggcttgccccaatctcgcgaaatcaccaaatgtaagcaaatattccacaaataatgcatctaaatatatacgtatgtttaaggttctggtatacaggtattaaaagaaaacactatcaacattcccaataagatataccacaccacgtgagcttatagaagcacgtgaccacaattcaccccacaggtgtggcttttttggtgccgtagaaaagactcattcatgaatcgtcggaaacccatagtcatcttcgagcaaaaggtatatataagcaacagagggcagtagttctcgagaccaccatcttttgattggaaatagtttcgtttagatggggtgcacatagtttttttcaactgcttttcctcgaggtcacccaaatatacaacgagatgccagttgagtttgctaccaatccttttggcgaggccaaaaatgcaacttcactgccaaaatatggtacacccgtaactgccatttcatctgtgctgttcaataacgtggactccatttttgcttacaagtccttttctcaacccgatttgctacaccaagatctaaaaaaatggtctgaaaagcgtggtaacgaatcacgtgggaagccatttttccaagagctggatatcagatctggcgctggtttggctcctttagggttttctcatggattgaagaacactacagcaattgttgctccagggttttcgctgccatacttcattaactctttgaaaaccgtctctcatgatggtaagtttcttttgaatgttggtgctttaaactacgacaatgctaccggctctgtcaccaacgattatgtaaccgcattggatgctgcttccaagctgaagtatggtgtcgtgactccgatttccgctaacgaggtacaaagtgtcgccttactggcattggcgattgccactttcagtaataactccggagctatcaatttatttgacggattaaactactcgaaaaccgtcttgccgttggtcgaatctgttcctgaggcatctattttggcaaaactatccaaagttattgcaccagatgctgcctttgatgatgtcttggataagtttaatgaattgactggattgagactacataatttccaatactttggtgctcaggatgctgaaactgtgtttatcacttatgggtctttagaatccgaattgttcaactctgcgattagtggtaataattccaaaatcgggttaatcaacgtcagagtgccattaccttttaacgttgctaagtttgtcactcacgttccatccactaccaaacaaattgttgttataggccaaactttggatggttcttcgccttctttcttgagatctcaagtttcagccgccttattttaccacggccgcacctcaattagcgtttctgagtacatctatcaaccagatttcatttggtccccaaaagctgtcaaatcaattgtatcgtcattcatccctgaattcacttacaatgccgattcatctttcggcgaaggattcatttattgggcctctgataagagtatcaatattgatgttgcctccaaacttgtgaaagctctgtctttggaagatgggaaatttgtgtctttgagaacgaaatttgataacttggctaatgctggtaccttccaagctcaatttgtgacctcgaaagaacagatacctgtttcaaacatcgattctacgaaattatcagtcgttgaagatgtcagtttattgaagcatttagacgtagctgctaccgtcgcagaacaaggttcaattgcgttggtttcccaaaaggcagttaaagatttggatttaaattctgtagaaagttacgtcaagaatttgggaattcctgaatcattcctaatatctattgcgaagaaaaacatcaaattgtttatcatcgatggtgagaccactaacgacgagtccaaattgtccttgtttatccaagccgttttctggaaattggccttcggtctagatgtcgcagaatgtaccaaccgtatctggaaaagcattgattcaggtgcagacatttcagcagcctcgatttctgaatttctcactggtgcattcaaaaacttcctcagtgaggttccgctagcgctgtacactaaattttctgaaataaacattgaaaagaaagaggatgaggaagagcctgcagctttaccaattttcgttaatgaaacatctttcctcccaaataacagtaccattgaagaaataccattacctgagacctctgagatctctgatattgccaagaagttgtccttcaaagaggcatatgaagttgagaataaactaagacccgatttacccgtcaagaacttcgtcgtgaaagttaaagaaaatagacgtgttacgcctgctgattatgatagatatattttccatattgaattcgatatttctggtactggaatgacttatgacatcggtgaagccctcggtattcatgccagaaacaatgaatctttggtcaaagaattcttaaccttctatggtctaaatgaatccgatgttgtcttagtccccaacaaggacaaccaccatttgttagaaacaagaaccgtcttacaagcatttgtggaaaatttggatattttcggtaaaccaccaaaaagattttacgaatcattgattccatatgcctctaacgaagaggagaagaaaaaattagaggatttggttactcctgccggtgcagtagatttgaagagatttcaagatgtggagtattatacatatgctgacatttttgaattgttcccatctgttcgcccatctcttgaggaacttgttactatcattgaaccattgaagagaagagaatactcaattgcctcctctcagaaagttcatccaaatgaagttcatttattgatcgttgttgttgattgggtggataataaaggaagaaaaaggtacggtcaagcttctaagtatatctcagaccttgctgtcggttcagaattggtcgttagcgttaaaccatctgttatgaaattaccaccatctccaaagcaaccagttattatgagtggtttaggtactggtttggcaccattcaaggccattgttgaagagaaattatggcaaaagcagcaaggttatgagattggtgaagtcttcctatatctaggttcaagacacaaaagagaagaatatttatatggtgagttatgggaggcttacaaagatgcaggtattatcacacacatcggcgctgctttctcaagagaccaacctcaaaaaatttacattcaagatcgtatcaaagagaatttggatgaattaaaaactgcaatgattgataataaaggttcattttacttgtgtggccctacttggccagttccagatattactcaagctttgcaagacattctggctaaagacgccgaggaaagaggcatcaaagtcgacttggatgccgcaattgaagaattaaaggaagcatcaagatacattttagaagtctactaaattaatatagtaataaaaactaaatatctatttattgaacctgtcttgaacatttctattttttttttacttttagttttcttctatgcgcaagcttttctattggctgccaaatagaaaattattgaaatatgattacattacaatatttatttgtcttatgaaaactaaccatcacattatactaactacggaggtaccatcttgaaatctcgtcctgaagaccctattagcattggcaaacataccttctttaagcgagactacaatgaactgagatcctttaaaccttgttttaatcaaatgacctatattttgcgtatgacttaaatcaagagcagcatcaacttcatccaaaatatacataggcgctggtcgaaattgcaacaatgccataatcaatgacaaagcaatcaacgacctttgcccaccggacaattcaatcaaactttccttccatatattaccaagctttactttaacctctaaaccctgcgttacgtccttaccttcgcatggaaccaattttgcaaatgaatttggtaaaaggtctgcaaaaatattaccaaaatcaagtgtcactttctcccatgttttgactaaagtttctcttttatattcgttcaacttcgatatagtctcttggattttcatcttatctttttcaatcgttttaatcattgtttttaatgctgcctcctttttctcaacattttctatcatattcataatatttggattaactttttttctgagctcttgaaacttctcgttcaattgtttactcctttctctgtaagtatccaaatcgataccctcattttgtttgacgatatttctcaccagatcaaaatcctcaagaaattcgtgtttctgtcgcagatcttcaattatcttttccatgttgttcgtattagacttatatttgttcaagtcatggaccaatttttgtagttctaattcactgctttttttctcgtcctgttttttctttatcaatgtttctaattcatttagttcatcatcaatgtccatcaaccttttcttttcttcgttcagttctgtctggactgttacaaggtcgtcttcaacacctcgtatctttccctccaaatcagaattttccaatttcaaactttcaatagatttcaaatggttatgcaatagcgtcttattagaatctagttctgagctcaattgctctgtttctaattccaagttttgaaacaagtcatatttacgttctgactccgattcctgctcctccagctctttcgccaatagtttcaattccttctttaattcatttaacttggatcctttatcgctatcgtactccttcatgtctttttcaatggtcgaaacttcttcttgacatttctttaagctcatttgcttggttttgatttcattctcacactctccaatgtccctcaaaatttcttcattcctagcaattatttgggaagatggattcgcgtcgagattacgcttagccaaatccaatttatgcaacgagagatttaaatcactttgaatggtctttgttttttgcgatgtagcatattgcgtctgtagctcttccgttacatggttgagatcagcctgaatggtctcaatttgtttttgaatttgattgtatttttgaatatcaactaataacgattcagaggtatttctactaccaccagacaatgtaccctctgggtcgtatacatcaccttgaagggtgatacttctagcgcggatctttggatggaaggtaattttctttgctgtttccggatcttcacagattaaactatttccaaaaataaattccatcgctttagtgatagattcatcaaaccttattaaatttattgccaattcaactttcccaggagcaattttcttggctaaatcaagcacttgagaacttattggcctcgtatatatcttatcaagaggtatgatggtaacacgcttgcgtaatcttcctctttctaatagctgagtggccgtctgagaatcttgaacaacaacattgaatagcctacctccggcacaagtttgcaaagcagtagcatagcgaatattatcattatctatctggaaaagttgacccaccaccccatggacaaagctggcttcaaaattaggataaggtttcgtatagttaaattccagatttgttacgcgtctttttaaatattcagagttcttacatgtttgataataatggctcttcaatttatcctctctttgcttcaggtctttaattcgtgatggatcaaacccatattcgactagtcgggctcgtagtttatcgcacgtttcttggcattgtttaacatgcttcacatttaactcgttatctttcgtggcctcctttaatttaggttcaattgtcaatagctctttcttcaacaactccattttcatgcttgatttttttatcgccaaggagacttcattcagctcagtctttgccttggccaactgtgcgttataaccaccgtctgcggcaccggtcgaggaaatacctgtggttaaagtggaaactaattcttcttttcgtttataaagatccctttgtttactgagttgttcctgcaccattttataatccttttcagtgttagcgtatgccgattttttttcgattagctttgcagaggaacttgcaatttctgactccagagcctttgatttttcagtagtatcattcaaattttctacttttatcgacagtgaagttttcaaacgagaaatttcatttaaaagaccgttctccttattttccaacttggagattgtgccttctttgtgtagttctttttctttctgaagtttgatttcctcgacatcctcattcaaactgtctatttcttcggaagttttcttaacaaattcatttaacattttcatacgagtctcaccgttctccagagtttctcttattgatgtatgtttatgtttaatgttatagtattcataagatacaacaattcgttcagttttttccaaatcagtctgagtagactgaaattctaggaacattctcttttcgtttcgaagtttttccagtttaggttcgatctcttcagttaacagagtcctgttctcctgtaatttagtttctttcttagacattgttctttctgccttttccctacgatcctcgaacatttttgtccctgctgcctcttcaatcagtgataagatctctgagggtttcatattcaaaaccttggtaattttaccttgcatgattaaaaaattaggattattgatatttaactgcacggattgaaatagttgcaaaaccgactgttgaggtgccctatgcccatttatcagatatttagaagttccaccaagcacgacttgccttgtaacagagatttgaggagagttagtgaacccaatgggagaatttgatttatcggtattatcaaaaacaatggttacgcttgccttggtaacacctgcttgaccacgcttatagatcaaatcttgcaggctagatgctcgcacagtgctcattgatgctataccgagcacgaagcaaatggcgtccaaaatgttcgacttaccggacccatttagacctgtaatagcattgaattgagggtcccaatcagtaatgactgttcttgtagcgtatgatttgaaaccatcaataatcaattcctctaccttcatgcggtaacgatactaaaattgacttgtatttacgtggtctgcctcgagatttcttgactgcaccgtgtgtttactgttgttgatcttaaaattagaaatgcccatcatcagagccacgcaacacggtaatcactataaacgcgtaaggcagaaagccattttattcaagaagtcaaccccctccatgaagcaatgcttcacaggggagaaggggggagcttatgagagtatattaaagtttactttgaagaaatattctattactacagaacaaaatctaatttagaaatttttctttaaaaataagtgttatgttatattgtattgtttgctttgaggaattttttgagttatctttttttttttagatcttgcttaaagaatgactattttacataatctaatcttgggtcttttgagaaccacgtaacaaaccagttcttctggcggcaatcaaaccggccttttgaccagaaacagcacctctagagatggtagaagccttaccaatatgttgatggttaccaccaccgtgagggtgatcaactggattcatggcaacaccacgggtctttggccaagagtttctcttcaatctgtacttgtggaaagcacgaccagccttcaacaatggtttgtcaactctaccaccaccggcaatgacaccgatgacacctctggcatcagaagagataaccttcttggcaccggatggtaatctgactctagtcttgttttcgtctgggttgtgaccgatgataataacgtagttaccggaagctctggctagggcacctctgtcacctggcttttcttcaacgttggagacaatggtaccttctgggacagaacccaatggcaagacgttaccgacgttcaaagaagccttcttaccggcgtaaatgaattgaccagtgtggacaccttcgttagcaataaagatttcttcacgcaatctgtacttgtatgggtcacggaagacaaccttggccaatggggcacctctaccggagtcgtggacaatttgcttaacgataccacgaatgtaaccgtgacgttcagcataatccaaagttctcaacttggcagcaccttgtctcaatctggtgtgggaggtaaagatagaaccagcaccctttctttggttacgaataactctacctgaataaaaaataatgagaaaaaacacagttctgttagtatacacgatacattttcaacaaaaggaataaaaagactgtaaaagggtgtgatgacattgcgccattacgacaatcacatggttgttaaatcacggtgctgacatacccattgcttattgatctaatggtttcttagtttgctcagaaatggttattagtcgctaaaaaatgacccaataataaaaaaaacgaggtaatgatattgaaggaggggaggggcagggttcaatcgattatgcctatgcgatagtgcattgcgtagtaatccataggttcacatccatgtgcactggtgctgcgtttggcaattcccatactattccagattgatctgatcgtgcagagcaatgccaaaccatcgaccgtaggcccaacggtgaaacaatacgcggagaacgcttagccgctaggcagaacgcctagtttacacagtgggagaatgaggataggcctctgcctacggtaccttcgaatacagggaaagtgggaagagtgagctgccgaagtgaaagaggcttacgcattttttctttgggaagcggacgcaggactaagctcatcattttcgaaaaaaaaagaaagttggagccggaaaggaattgggtgttaaaaatgtacgggtgaaaaaagtcttattttgtcttaaaaggggttcccccagccgcaaaagaaaagaaaagaaaaataatagatcaattttagtttacttagcaataaacgaatatatgtattttatgttaagttctcactgtttatacccccttttcaattttataaagatctaagtagcagccacggttggacgatcggaagacgaagcaggcggaggtgggacatcattggtttccgcattgtcttgcccttcctgcacttgctccgctggctctactggcgctggcgctggcgctggctctgccaatgctgctggaggtgggtcgcgcgcattggttaagttgtccttgaccaattgtttaatttcttgaatcttagagacgtaagcgggcttcactattatcgatttgcccctcaaagtagctgtcttggccacactgtcacaaatgtccccaattggggtttcagattgcaaagtgaccaaagcggcagtaatttggtgtggagcaaaaggaatacactttctcctgtacaccttggacctgtaaatccagatttcttgaggcgagtagagctggaacaactcacggatctcactgtcggttatatcgtctggcaggtcgtgacagtaaaccgtatccgcggcagtctctggtgtcttcttaaccttatttttttctttgggcttctttacatccgtgtctggagtagagtctgcctcgtaaggaacgtgtaactttagaaatagtttctgattttggaaaacggttccgttcaagtcttgaatggccttcaaagccagagtattgtttgcgaactgggcaaatgctatgcctagtggtttgcgagggttgctattgtgccttttgctgaatctgcggacggtctgcgttggaatcaacactgaactggcgccatagttgtttaggaaggcatgtaggtctcgctcactcgccgtgaatggcaggttcgaaatgtaaactgtggtaatggtagtggtagtgtcactggtagtgtcattgttaacttgttctgtcattgcgggcttgtttgtatgcttatgtgaggccttatacttctctatgtgttgctactcagtagaaggtcaacaccattgttttatacatcatttatcttttgttattaatttgtgacgcttccattttgtggcacataaggaggaaaaagaaaattaaaagaaaaaaaaaaagaaataaaaaaagaaaacggtactggatattgagataaattttccttcaattaagataataaaacatgttatataaaatcagacaaaataatatgtaaatttttaacgtattataatcttaaaaagtttatttcttggcagcagccaaagccttagcagtgccgtgtagggcatgcttgtggtttcttctaaactttggatcaacacctttcaaagaagggtacttgtaggtctttggcttcttgataccgtttctgtgagcctttctggtttggttgtgagcggtatggttcttagacttagccattttctggagaagacgatgaatgtacgcagaaattgcgaatggtcattaaaggttagtaaaaatgattcataacggtggaggggagtagcgtggcagctaactgccaatctgaagtggtgctagcgggggcaacttcgaacaagggtatgctaaaggtaattgaacgttcgagaaagagcgttcgctataagttcaaacactggtaactttccattattttcccttctctctttttttctttatatcctccactatatgccactcagcgcacctcagatttggctacctgcatttccaatgggcgaaatggggacttcatgataatataacgtactttctaactgtattgttgttccggggttcttgaatattgaatgaaaaatgttataaaataatgggttgaatcttgaaatatgcagtattgaaatattctgaaattgtatgtatccagagattatggcaaagcctaaagggaaaatggtagacttcctacattgagaatatcgctggttttcccgagcgcggctagcgaccatttttctttgtccttacagaactaaaaaaaaaaaaccaaaaaaaagtcgaaaacaagaatacatgcgctgtatgggtctaagagtatgtacggatgtaaaagaaaacagtactagacagagcgcataaaaaaagcctaatcccttttccgtctgtatacttgtgctcccttataaaaaaaattaaaaattaaaaaataaaaataagaatagtgtataaaattatttttgctttgattttagtttatttatttactttctaaatacagtaggttaaataaggatcggtttcttgaagaaattgtaacaagactcagaataaatatgaatatagggaatatgacggataaacagactactttaatttgtcaaataatctaggtgccgtggcagtgtccaaatagtgctgtagatggaaaaactcctccacacagtcctccttgtgttcaagatccgcgtagccgggttgttgttgctgtatcttgactctctcagcacactcctcgtagtggtgcacaagggccttaccctcctccgtgttcttgaaatgttctctcaaatcttccaactgatcagtgacttcttcctcttcttcctcatcttcgtcgtcatcatcatcatcatcttcgtcttcgtcttcatcctcatcttcatccccattttcttcttctttttcttctccttctgctgccttttcttcatgctgctcgttatcgtcatcttcggccgcggccacaacaggcacaacggttatctttagttgttcccagtactcaccaactagttccaacatgcccattttctatttctttttctttatccgtgtgtgtaggtgtaagtgtatatgtgtgcttctgttaatgtgagtgcgtgtatacaatatgtgcaaataagcgccaaccaatactgcccttaagactgagtaggtcctaatctcgaaaacccggtgtgggccactttccagcaaagcgcctcttataacaagcaccgcgcaggggaggcgcgccccagtccgatatgcccggaacgtgcttcccattggtgcacggtcacgtgctcacgttctgctgtaggtgacggatgtaccggcaggccgcctccacggtggtcgctttggacggcgcggccgacacattttgctgtttccactccgcggggattaaagacgccagttcgtgcagcgcgaccgctaatcgattacgccgtgcttgctctgcatgcttgtgtgattcgcgcttgtcatcgtccacgagcgcgcccgatgaccgtcgcttactcagcgaccgcgaatggctcgatccgtgcggcgcgattacaggagactcacttgctacgaccacgccttctgcgctgctgctggtcttggccgtgaccggtgatacgcgtcttgtgctgttcgacggcagaataactttcggatattgctttggtttcggtttcggtttcggagttgggataacgctgtcgggcaattcgaacagcgaagtggccgaatccggcccgggtttacctctgcgcttgttcaaatacggactactattactcttgtttttagtgactttgttagcggatgtggtggaagtagcagtagcgaccaagttcggcgaaatggttacgggaaccgcactttgcgtgtgtattagcggcgaatataatagccgcggcttgattgtagcagttgtagctggggagtggtgcgcatgcgagggcatcatccagtccatatccataccttccaccagctcaaaggcgcggtctaggtcgtccaacgcgagactgtcttgttcattttcattctcgttcccattctcactgctgttgtggttctcttgactgttcagctcgtcgttttgctcgttgaagtcctcgcgcccatcatgccgtttcgtgtttacggtgataaagtctccgactttatcaagaatgctgctcttgggctctagatcgtccacaaaaccgtgtattccctcagaagttgtacggcccatgactttctgctactcttgttctgtctcctttgctcatctcttctcttctggtccttccgaagcatgacttcttccctggttatatacatttttctatggtcaagactcatttgccaaatatttccgtgcgagcggccgggtcagcctttcgcctaccacatattaggcgaggcaaaaaaaaaaaaaaatagaaaacgagaaaatcgcacttgcagcataggaaatacttgcacacagacatacacatacacaccgtacgcaaagaaggcaaggcagcaagaaaaactgtgggaacgtagaaatgaacgtacctacggcgccaactcccaacaaacatttgaacatacctgatttgaggttcgagaaagtgttcaagaaagctttacacagggaattggcaccctcatcgtctctctcacggaaggcgggtgtgattacgaaagttgtggttcgcgatgtcctgctcatgcccttattgcagagctttgttttgtcactcgcgctcatgggtgtgaaggaatggttgtcttacatacgcttgaaaggacgaaccctaggtgaccgcattagacagagactttttccgatctaaataatgcatataaccgtatcttttttatatgaacctagttttgctgtataagagccgagaaaaaaatataggaaaatataggaaaatatgcaaaatagaaacacgaattttttttttgttagagaaaaaaagagataagccctgtaggggctcgaacccctaaccttatgattaagagtcatacgcgctaccgattgcgccaacaaggcattttaatctctggctactcggcactaaaagatgcaccacatccgatgtttaggccgcaccataattttttctttttcctgtctctttgtcctttcacattgcacaaaagtagaggaataatggatggatctaggatgtacgtatatatgatattagcggtctgaagagaaaaaaaaaacagcaacaataacatcgcacttgatgatcagaagggcccctaccaccttgcagctcagtcacgacgacgtaacctctctgatcgatgacctgaacgagcagaaactcaagcagcagctgaatatcgagaagacaaaatacttccaaggaaaaaatggcggatcgctgcactccaatacagactttcaggacacatcgcagaatatcgaagacaacaataacgataacgataacgatatcgatgaagatgacgacatgtcatcttacaacgacaaagcagcctcggtagcgcacaccagagtcctcaattccttgcatctgtccaccgacagcaataccgcccacgagacgtccaatgcaaacgacaaccacaaccccttctacatccgcgaggaataatagcatatccgcatacgcacacgcacacgcacacgcgcacgcatccacattcactttcacttataaaatttcttctctctagttttatatacgttgtattagaaatataaaatatgacaatagtacactttgtaggctctctttttttttttttttttttttcttatatatttttttacaatgaccacggtttgtacacctggggctgcaattttgcaatggagtcgccttcgcctacttcctcgccttccttgcctacacgtttcacgccatgtcctgtggccgtattgccgtcttcgtcatcgccctcctggtccttctccactagttgtatgcccgagtctacttgctccgagatcagtaccagtttcttcgacacattcaactcctccagcgacttgttcaggtcaagaatctgtttactcagtgataatcggtcgttcagcatcttttcagattccttcacatatttcagtttttccatctccagttgcgtttctagatcgcacagctttgtaaacttgctctctaatttctccatggtcagcttgactaactcttggattatcgcttggctttcttcaatgtacttttcggagatctctctcgacttatcagagaccttacccaatttgtcgtcgccttgcagtagcgtctggacagcatcattcacgcattccatcaacttcgaaccggacacactaccatcgcggctgtcgccacccttaccattcagcgttgaaccaacaacttctcggatgtagttgtcctcgatcggtaagcttaggaatttttcaatgcagtcttctacacgcttgtgcccacccacgtggtcagcaatcttctcccactggtcttcatacatttcaataccctccagcaatagtagcatctcctggtctgaccagttttttttaaccgagtttccgttgttttctaatctgatgaaatctgaagattgaaagttggcaccgaaatgaccctcttggaaacaacgggagcacaggttggtgtcccgtgcacgcaaattgtggtagcgcacattgattgactcgttaccgcatgtatggcaaatgtaaactttgtgaatctgcctggagtttctactttcgtcttgtaatgcattgaagtcttgtgcagaatcgtaaacgttcttcttgattgtgagattaacgggaaattccttcttgacttgtggttccgctccatctcctccttccacttcttgcttgatcacattctctggtaaaaatggctttaacccctgcggagtgtccagaaccacttggaagtggcccgtaaaacttggcccaataagactgggcttggtcctggggtcaatctgataattgattaagccccatttttccaagaacgcgtgaatcttcactatcgaggcaacatccatggcaacatttcttctcacagcggtaatggtcaaatattcgtacggcgaaagacggtacgtgttgatgataaaatttcttgtgtccttatatgcctttggtgtcttgaaccttgatgaatcgttgaaaaagtcgggattggatcttttttcgatctcgtggatcttcgaaatatcaaaccaagaggcaaacgacggaataatcaccgggtgagtttgctttgccaggaacctaagggccttctcctccagtttctgtgcttcttgctcgtaattgattttcttatgagctacttctgctcccaatgtggcagattcctccttcgcctgttcctgtgctaagtgagggaaagatggcgtgttggtgcttgtggtgggtggctcctcggtcgcttcgtgcgagtctaccatagggacatccttatccttttcagtgtcgctcattatcctggccttctatctactctttgcttctctgctctacccttctctctataaacctcacgaactaattcaatgttgatgaaacttattttttccaacttttttacatcaagcgggtgacaaagagaacgccgtaattaaattatcatagaaaagagtaacggattaaggaagtatcaaatttggcgatgagatgagcagatgctcaaacgcggcgctgatgactgttgttgaggatgctgttggggccagggtggctgcaaggacgagaaacatgagcaatggcgtcaattaccgggagaaggaagtcaatgacctaacggctgacatttcagattcagattcagatttggattcagaggacaataaacatggcaaaggcgacaatgacactgcccccatatggttacaagatgatgtgcattcagacgaagatattcagctggactcagaggacgattccgatacagaagctgttcaagcccaagtggtggataaattggcaaaagacacgaaatcagagcaaaaatccttggatgatgagctctccgagatggataccaagacggtttctttaaaacttaagaaactaaacgagtttgtgaggcagagtcaggtatattccagtataatcgccgatactttactacatcgatctaatgaagtggctaacgctaatacaaaagataacagcaactctgatgatgaagaacattcttcaaaaaaacgtaaaacaaaaaaaaaatcaataacagatttcttcaaaaaacagaaaaagaacgaagatacaaccacccaaaacggcgcaccagacgatgcagcaataaagcaacctcgcctattgaaaaactgtattttaaaaccttaccaactagaaggtcttaactggctgatcactctttatgaaaatggcctgaacggaattcttgccgatgaaatgggtcttggtaagactgttcaaagtattgctcttttggcgttcatatatgaaatggacacaaagggtccttttctagtgactgcaccattaagcaccctagataattggatgaacgaatttgcaaaattcgctcctgatctaccagttctaaaatattatgggaccaatggttataaggaacgttctgccaagttgaaaaatttctttaaacaacacggcggcacggggatcgtcatcacatcatatgaaattattttaagagataccgacttaatcatgagtcaaaattggaaatttttaattgttgatgaaggccaccgtctgaaaaatataaactgtagattgattaaagagttaaaaaaaatcaatacttccaatagactgctactaacagggacgcctttacaaaataacctagctgaattatggtcacttttgaatttcataatgcccgatatctttgccgatttcgagatattcaataaatggtttgacttcgacagcttaaatttaggctccggttccaactctgaagcattgaataagttaatcaacgatgaactacagaaaaatttgatttccaatttacacacaattctgaaaccattccttttgagaagattgaaaaaagttgttttggctaatattctgccgccaaagagagaatatatcataaattgtccgatgacgtctgcacaggaaaaattctataaggctggattgaatggaaagttgaaaaaaaccatgttcaaagaattaatcaaggattttttcacattgaacgatgaatacatcggccacgtttctaatcggtccatacgagatttcatcaattataaactatctggtaatgaaacttcaaatacagacaataaaatcaatccaaccttgttgcaaatggacaaactatataagaagaacctgcaaatggaaatttcaaataagaaattgcaaaatatgatgatgcaattgagacaaatcattgactcaacttttttgttttatttcccatatttacacccagaagacttgactttggaaactcttttaaagacgtctgggaaattacaaatcttacaaaaattaatccccccattaatatctgaggggcacaaagtgcttatttattctcagtttgttaacatgctcgatttgatcgaagattggtgtgatttaaattcgttcgcgacatttcgaattgatggttcagtaaacaatgaaacaagaaaggatcaactcgagaagtttaatagctcgaaagataagcataacattttcctattgtccacaagggcggcaggactgggtattaatctagtcggggcagatacagttgtcttgtttgatagtgattggaatccacaggtggatttacaagccatggacaggtgtcaccgtattggccaagaatcaccggttatagtatataggttgtgttgtgataacaccattgaacatgttatattgaccagagcggccaataagcgaaatttggaaagaatggttatccagatgggaaaattcaataacctgaaaaaattggcgttaaatgaagggttcttttttgaaggcaaacaaagcgggtgttaatgtcactaataaggacttagtccaggagttatctatgcttttaatgagcgatgaatccaatataggctttgaaaatgggggacagaaagaaaataaggctactgagggccaactgactgataaggaggttgaagaattgaccaacagatctcttgaagcgtacaaggccaacagagtcgtagatctgccgcacgtcaagctatttgaaacaacctccggtctttaacttggttatcatacaatattgtttttattaaatgtttgtatatatgtacatatacatacctatatattgatcaatgttcttgccgtacaaattcttcctctagttgttcctttagttcacggtttttgaataaagtatccgcagtattcattcgttgcagaaaggtatcttgaatattattttttgtgttctggaaatcagcttttagtttagtaatccattccagtatcaaagtcatatccagatcatgttttaccagacggttcctctcagaaataactttctttttcaattccatgaaacggagccagttggaatgattctcttctatataggcaggatcgtattgatcttccaaatggagacctctgacgtccatatatgccattctttgcgaccattgacttatcattacatcgccccactcttcgtacacttcgacgttttcaagacgaatcgattctgccagtttagccatttcggtaagaaaagaatctaatgaatgaaacagtgatttttcaaagtctaacaaatgtattttataattcttcagtatcgatgtgatagatgatttggtaatgtaagcttccagttcaacttgacccgattcatcaaaatactttattttattttgcacaggatcgaatttagaggtacaattaatatctttgatttttgaatctagaaacactaattgctcattaacggtagtgttaaggtcatcaagattcctagtgatttctatagatttattttgcacctcggcctcgaacacagactgtatctctgaatccaaaagtgccatcgcactgtgtattttcgaatctatagccttaatccatgcttcatattccatttttaatgattctgcctcgtaagtttccaattctgcatggctattggaaccaatgataatctttgacaaatcctgcaaaatagcagcagtgacgagttgtgagttcccgtggccatcctgtactccatcgaactcgtattctttattttcatcctcaattccgacatcatcctcatcctcatcttcatcctcatcctcattttcattctcatcatcctcataatcctctgtttccgagtctgtctcaaaaatgggtttggtgagcgtgccatcagcgctaaaggagccgtatttcatccaatccgtagaggagttaaatggattctctagtacattcttcacattgtctgtatatggctttaaatagtaccaggcaatccttagatgatttaataaaggtcccaacttggaatgtagcgaacagcagagctcatttagccttagaaaagagaaaatattgtaccaaaagcggtaaaaatatcccataattctcttcaaggatgagttggggtatctttcaatcagtggttttatcgattgtgagtactttccaactaaatagtcagaaaccgctgaaccttcaaccaatttagaatcgaatagtgagccaactgaaaattcagtatgccggcaaatgggctgtaaatctgtggcaaagcttcccagaccattttgctgacagaccagataccttgcaataaacacgcaagccagcaaagcagtcgttactttgaaaacggccttcatgatttttagtaaagaactaaccacctttttcttagttaagaaaaggtcaatcagtaacagaaatatgatagtagcaacacccaaaaaaatgctatcttccaatagtcaaaaaggaagcctcgatgccatacaagtctcttctaaagtactattatgtaattcctgttaaatgatacctgtattgtggcttaaaagggccgaaatgacaacaaaatgagtagggttaatttaatttttaaagagggcatttatctaaaaaatgaaagacaactatagggctggtaattatagaataggtcttagtagggttatcccttcctctagaaaaaaagaaagaaaaataattttaagtggccaattagaaccaaaaccaacagtatcgtggtatcatacgctccaaagcaactagaagaaaggccttatttgaccattggattcagtattttttctccaagtagcggttaaaagactgagagactaaagctagatagtgggtttgagtgactatccccttttttcctcctctttttttattattttgattttatttcattttgattttatttcaacacgattaagacacaagcgttacttccctagactatagtctctgccgttcccattctattgatttttggagcagcagtttttacaaaagaaaagaaaaaaaagacgaaaacaacaagccagagtaaagatgtcgttttggccatttggacagaatcttaatcactctaatattaataagatcctagatgaatattttcatgtgctacacgaactggaaaggattaacccaagcgttggtaaagccattcccgctattttcaacaacgttcaggaacgaggtacaagtgactccctagattctattccggaggagtatagtcatggtgatgaagtgaaaacggcacgtgggagatcagaagagtcgatttgagaaggatgatcagcaagaacggtatgagaaagaggaagaggaacggagcatgaactctagcgaatcttccactacatctttttcttctgggtcaacttctaaaactgatttagatgaggaggatatcagcaatgctactgctcccatgatggtcaccacaaagaatttggataactcttttattgaaagaatgcttgtagagacagagctactgaacgaattatcgagacaaaacaagacgctacttgacttcatttgctttggatttttctttgataagaaaactaataagaaagtgaataatatggaatatctggtcgaccaactgatggaatgtatctcgaagattaaaaccgccaccacagtggatttgaataacctgatagattatcaagaacagcaacagcttgatgatagctcacaagaggacgtttatgtggaatctgatacggagcaagaagaggagaaagaggacgataataacagcaataacaagaagagacgaaaacgcggaagctcctcgtttggtaacgatgatatcaacaacaatgacgacgacgacgatgcgaatgaggacgatgaatctgcttatttgacaaaggccaccataatatctgaaatcttttccttagacatatggttgattagcgagtcattagttaaaaaccaatcatacttaaacaagatttggtctatcatcaaccagccaaatttcaattctgaaaactctcccttggtacccatattcttaaagattaaccaaaatctgttgttaaccaggcaggatcaatatttaaattttattcgaacggagagaagctttgttgatgatatgttaaagcatgttgatatttccctattgatggattttttcttgaaaataatatccacagataagattgaatcacccacgggaataattgaattagtatatgatcaaaacttgatcagcaaatgcttaagctttctaaataacaaagagtccccagctgacatccaagcatgcgtgggtgatttcttaaaggctctgattgccatttctgctaatgcacccttggatgatatttccattggtccaaactccttgacgagacagctagcatctcccgaatccattgcaaagctagtcgatatcatgatcaaccaaagaggtgccgcattaaataccacagtttcgattgtcattgagctgataaggaaaaacaattcagactacgatcaagttaatcttttaaccactactataaagactcatccaccttcaaatagagatccaatatatttaggctatctacttcggaaattttcaaaccatttgtccgattttttccaaatcattctagatattgaaaatgacgccaacatcccattacatgaaaatcagttgcacgaaaaatttaaacctttaggatttgaaagattcaaagtggtggaattaatcgccgagttactgcattgctctaatatgggattaatgaattccaaaagggcagaaagaatagccagaagaagagataaagtaaggagccagttatcccatcatttacaagatgcattaaacgatctgagtatcgaagaaaaggagcaacttaaaacgaagcactctccaacacgtgacactgatcacgacctaaaaaataacaacggtaaaatagataacgacaataatgataatgatgatgaaagtgactatggcgacgaaatagacgagagcttcgaaattccatacatcaatatgaagcaaaccataaaacttaggaccgaccccacggtcggggacctattcaaaatcaaactatatgatacgcgaattgtttccaaaataatggaactattcttaacacatccttggaacaatttttggcataatgttatattcgacataattcagcaaatcttcaatggaagaatggatttttcctataattccttccttgttttgtctctgtttaacttaaagagctcctatcaatttatgactgatatcgtcatatcagatgaaaaaggaacggatgtttcccgattttctcccgttattagagacccaaattttgatttcaaaataactacagacttcatattaaggggctaccaggattcatataaattttatgagctaaggaaaatgaatttgggatatatgggccatattgtcttgattgccgaagaagtggtcaaattttctaaattgtacaaagtggaactaatatctcccgatattcaagtaattttacaaaccgaagaatggcaatactactccgaagaagtcttaaacgaaacaagaatgatgtactctaaaattcttggcggtggaagttatattgatgatggaaatggtaacatcattccgcagctgcctgacaatactactgtattaactccaaatggtgatgcaagtaataataatgaaatccttgattcagataccgggagtagtaatggaacaagtggtggcggccaattaatcaatgttgagtctctagaagaacagttgtccttatctacagaatctgatttacacaacaagttaagggaaatgttaatcaatagggctcaagaagacgttgataataagaacacggaaaatggggttttcatactggggccgccggaggacaagaacagtaatagtaacattaacaataccaaccataatagtaataatagtaataacaacgataataacgataataatgataatgacaatgataatactcgtaattataatgaagatgctgataatgataatgattatgatcatgaatgatacattgttttgtacttttctttaatttgtatatatatatattaatttatatgtataagtaccatgtagttttctattcattcattcattcatcatgataatattacttcttacgtatcatttacgtgaatagatcactttaccgttaggcaattccattttcttttggcctttctttgcagaacccttttttactttgttccccttttttgtttggttaccatcatactttttactatccgttattatttcttcttttcctgcgctaccaacagatttgccaaacgtcatgttccaaaccgaagcaggtattctccaaaacaaacagttctttactgaaggtttatccaaggtatctggcgaaattagtgtttcacttccatcaggctctacaacatagacatcgctaaaccttacaaccaaacttttaccctcatccttttcatgttgtttaaacgttagttgttttacgcctagtccattggtatcatcctgttgtttacactgactgatgaagttttcaattcttgatctttgagaacgatattgaataatagaaatgatatactgcccaatattaacgactatccaaataaaggccagcaggaaccaagtcttaggcttcattctggaaaaataaaaaccacccttatggaaatcatagtttggaaagccattctgtagataataatcataaatcttacgattagagctgtttgaaagaatttgagtagcgaggtttaacctttcatacaatttacggtatttagggttcttatccggatggtacttcttggatagctttcttaagttttttgtaatctcctttgtactagaattctgcagtttaggtaacttcaagaacttgtagaagttcatatctgggccatatttcgtacttatttcattttgtaattggaaaatttctgtttcaatggtggtaaaagcatatgatagagataccaatcccaggacaaccaacgcaggtttccagtaaccgttcattcttttagtgatcttgtaaccttgattttttgttcgttttctattcttttggtacgtgttattttgaaaatctcatttttttcgtgattattaattttgaatatggaaattaaatatgatttaccttcaaattgggaaataatgtaaatacaacgtcaataaaagtatttgttcggtcacatatatttaactagcattgaggatggcaggtatcaagttgacgcataagctttatcagtattatcaattagccacaagctttttgtatgctgcattattgatacggtggctgatattaatgccactggtagggtctcggtttttaccgggaggaatccacgaattcttgatatatttgatgttttattccagcatcatggaagttatttggttgcttagattccacgggttcaaatatggtttgctttcaagaacgtttttgaaagacctaaattttatctatttagtcagcgtgatccatttttatgacgattatgagcatgcattgatcctcaagaatgcatcatattctagtttcattatttccttatctttatcacaggcatattgccattggtgcaaactttttaaacgtaagggcgtaaaggaaagaacacttgtatggaaggttaacacatttgttacattgccaattctctacctgagtgaatttgcattgctactattaaatatccaggttaagaactatcattctaccccgactttggacataatcaacagggtggttttactagcatacttccctgtactactaacagcatacaaaaaactattaacaaaatgagcaatcttattggtttaatacatatgtatacacatatacatatctgtacatactcataaatatctggatagttcgtcagccatttcatttgcaaaagcatcagcttcactactattctcgatagacttatattttagccttgcactttgcaaattcctaattatttgttcgaggggcatttcattaggaatttcctcccttattttagtagccggttgaacttcacaatttaaccagtcgtgggtatctataatctcctggatcctatcaagccccaatttttctccatagtcgttatgattaacagttggttttgaccttttccagtttacgaattcgatgacgtttgtaaaggcattgctccatatctcattcagttcatcaatttcatcttgctcgacttcttcgttcacattggccaacacaacaaaagtatttcgatgggcagctatcatgaattggtgcagcagttcttgaggttttgtttgccggatgtccgttattaagataattcctgccatgacatttctaagcggttcacattcaggcgttataaattcttccacccatactggtatctctttgcaagagtcaatataaagatcaaaatggactttatagtatctattttcccaagtttggtccttaactatactgatgcccgtgctagagcaatgaaacaggtcttgcaaaaattgtgtttttaaaaagttgtgtgggtgatctgataaaaccaatattttattctgggggtattgaagaaccatggtagattggtatttttgcgtatatatacttgctatcttgctgcatcagattttctctataaagagttttctgtttttcctctcttttcagaattcgaataggaatgagtaaacttgaatgacatggaatttacacatatatacacatatataaataagatgacttagttttctggcgattcagagtaatattgcaagtaagcagccatcgtcttcataccaccaacaaaatttgaaatatctaacttttcattgattgaatgagcaccatcatcgcctctacccattggcagcaataagacactagtgttcaaggcatcttggaaagtcaaagtgataggaatggaaccaccttccctggtaaaatcaggatcgacaccatagaccagttttgtggcctttttagcagcagtaaattgggcgttgaatggatcagaaacccaataagcaccatcatggatcaattctgttctgcacttgtttggagagttcaaggacttgaatttggcatcacaatgcttctggaccaaagaggtcagtttctcagaatccatgtcggggacggttctaatggaaaacttaccgaagaccttagctggaatgacagtctttgcaccttgagcggaaaaggcgccttccacaccatgaatggacaacgaaggatacctccatctgtgcatcaagatgtcttccttcttgtcgtacaaacttgtcttagagccagttgcagcgttcaattcttcgacgctaaattcgatatccttgtatagagccttctccttttcggttagaggagcaaccatttcgtcaataccgtcaatcaggatcttacccttagaatccacaagggaaccgagaacttgcattaaatcgatcattggttcagcaacaacaccaccaaagataccagagtgtaaatctgcacttggaccctcaatgatggtttgatagtagttgcaacctcttagaccataagtcaaaacaggcttcttagtgcctagccagtaattatcggaaatacaaacggcatctacacctttaaagtaaccattagcttcctttttaatcaattcatccaatttcaaagaaccactttcctccattccttcgaaacaagtaactaagttaacggggaattcttgtccggaggctttgaaggcgtccacaacgttaatccaagataataagggaccagtgtcatcggtgacaccccttcctttcatgatacctttagcctcatcaatgacaagcttgaatggctcagtatcccaaccatcttccaattgagcaggttgcacatcatagtgaccgtaaaccaacacagtcttttttgaagggtcgctgccgaacctagacagaatcacaggaggtagagacagatttggcgtagaaattggtggaggttgaatgcccagatccaccattttaatgtcatggaaccccgattgtgataattgctcggagataaacttggccttatcgaagactttggaccttagtgattcatccgaagaaacagcggggatttgaatagccttagtcagtctgctgaagaactgaggctttaaagaatcaatcttttggaaaacggaagtaagtgagtgagacatgcttgtgtacgatgctctggagcaactgaactaacaatgaagggagattcaattgataagaacaacatgttgctattatagtctctcttttttttttgacacattttcttgtagccgttttgaatgacgaatataagggatattgctaaaaaatgctgtggcattggtcaacttaaaagaatacgaatacttattctaaaagatgtgctcgagtatttaacccaccgattggcgcacaaaatgtgttgtggagttatcaatcactcgagggatttaatcgacttcttgtttagttcgccttcgctagtcataataaaatcgacttattaatccaaaaatttcaaactttcttgtcaacataacttctggaaagggtgtcagaggtttttccttcttgcgtctgctgattttattaggttgtttaatttaaagggctttgaacagaagtgggaacttcttccgccttattaagctatttttcaatcgaatataattgaaaaagtaattgctctcacaggtagtcgaatcgtaaaaaaagggcagtaagaacagcacccgacatggctaaccaggtaagtagtaaactgtttcgttccaagacgctaatgctattttattaacgctctcttttttctcgtttgcagaactctgacctttacaagcaaatcactgccggcagtgtagctgctgtgtttcaaacgacaatgacatacccatttgagtacttaaagactggtttacaattgcaaccgaaggtaccgctttcgaaatcattttacctcagattaagtcgtactttgttggctgctctgccctaaacgtggccgcatttggtaagactattttaaggttcgttacgttcgacaagttatgccactccctgaataataacattgataataatgataattttcaaagactgactggttataaccttttgatcgctggtacgttgacaggaatagtagaaagtttgtttattatcccttttgaaaacataaaaaccacccttatccaatcggcgatgatcgatcataaaaaattagagaagaatcaacctgtagttaacgcaaaggcaacctttcacaaggtggcgactaaatctactcctgtggctcgtatcgagaaactacttccagcggtaaaacacatgtatcaaacaagaggccctgctgcgttcgtccagggaacaacagccaccatatttaggcagatagctaacacctctattcaatttactgcatacacagcatttaaacggttgttacaagcaagaaacgacaaggcatcctcagtaataacggggttagccacatcttttacactcgtggcaatgactcagcccattgacgtcgtaaaaacaaggatgatgagtcaaaatgccaaaactgaatataaaaataccttaaattgcatgtatagaatatttgttcaagaaggcatggccacattctggaagggctccatctttaggtttatgaaagtcggtatttcaggaggcttaacgttcactgtttatgaacaggttagtttgttactaggcttctcttccaggtcttgataattttgtggatcttttactcttttctgtacataaattgccactatttaattattttctctacggtatcttttttagaacaaataactttcaattcttgattgaagttctaagggaagcaattcgtgcgcgagctcaaacatatcatcaacgttattgataatacccatatcgataaacgaatctaccaattcctgtttttgtaacgtgccgattttttgtttcaagaaatccattatatttaaagattcctcctgtatagtagaccacgtttgtttcggcaatattatcctattctcattcaaaaattgccttgtaagatgttttagatccattatttgcagcggttttatagaagaacgtctcaccgcagggacatttaaacggataggatcgttgcctatatcatccaaattttcgtcactggtgttttcaaacgaataatcttcgttttctgcttcttctgtctcctctttatcgtcgcttggtaaatcttcagatagtggttcttcctgttgcgttatggaaattggtaccggatcacgtactggcggttcatctacctgatccattccaatgcttggcgacgtgcgcaaaacttccatagagatactgttagctttatctggagagtgcactgtcaattcatcctcgtgtcctgtcgtgggaacatcttgtattattatcgggtcaatcttcctacttttcaagcctttgtctctttcctgcaattttgcaaatactgtttgcgataaggaagtataatcaggttgcgtttcattgccaatgttgttatctgtcagtttctcacttctgctccgaagaagctcattctcctctggttggctctcttcgtacgctaattcatctattagattccgtgcttgagttttattagtagttgtatcgttgccttgtgatttgcgtgctaacacttggcttaagtcttgtaaaaaacttcgtacttcgttcggatctttattgaggatgtcatgagacttagtagaagcagataaaagttttctataacctggcgtatttctgatcagtacctcatccttgagacgttgttcttcaagggctctctcccgaaagggggttctgatctctgagacttctgtattctcgttgttaccggcggccttcctgggagtgctcattattcatttcttatttcgttactaatcgtcgtgtgtgtcattaatcggtaacgcgtagcttcttaatcttatttagaatatgtaaataaaaaaaagtaaaaatcgaagcctaagcattttcaatgagccagtttcaatgagaaatcaatcactggtgtgccttgatgaatgctactagtgctgtaaatgtcaatgtcatcgcacaaatactcctcgaggttgtccaaattcaagcctccactacattccaagaggaaatgctttttaccattccatttgttcttaagactttgggcgcacattttcaaaccgtcacctttgaaattatccaacatgataacgtctgcaccagcttcaatggcctctgtggcttcatcttcactcaaacactccacttcgatcttcacagcaaacccgcacacggccctggcgttcttaactgcgtttgttatagaaccagtagcccaaatatgattatctttgagcatgaccatagaggaaaggtcgtatctgtgcgtgtcgcagccacctacaagcatggaatacttttctaatctacgtaaacctggtgtagtctttcttgtccccgcaatggtccccttgtaaccagtcgaacgcgccaaactgattatcttatgtgaggcggtggcaattccactacttctactaaggatgttcaaggcggttctttcagctaatagaatgtttttagcgggcccagtaattttagctacaacaatcttaccagagtcattcttcgaaggctccaagaaggagccttccttaaacaaccactcaacttgcaattcgcactgattaaagacttcttgcgcaaaggggacaccacacagcataccatcctgcttacagtacaaattggcctcctttaggtcggaaccaacaacatatccaccaaaatcaaaagaaggaacgtcctcgctcagccaattggtgacgtcttgtctccatgctccattaacgggcaataagtgttcataaacaggcattttttttttttggtgtgtgttctttctgaggattgcgttctttttgttgcgttattaagtggtgtctttaattttcgaatttatggcccaagatatacgaaaactgcggtaggagtcatgataaatgggggctcttcaaccaaccggcgtcaccaaaagcaaaaatatcctggagcgaaatatcacattgtttgtaaccaagcttgtacctttgacaagttaacttacgtcttgccggggtttgctactacgcattcaagtatataaaacgttgtgacacacaagttgatagaaacctcaggatgtataactacaattctagtttccatctcattagtcccaaatgacaataaaaaaaattactggccatggaagatgacaagccgaatattagctccttcgatcgaactgtgcgtggagaagaagctactactatttaataattagtatcccgtgattttgagctgtcgctggcattatgtacctgacattaggtatttaggaaaggtagggtagatcagtttagtacctcaatgggtgcggaaggttaatcttgaaaaatttgcgattagtagacaagtttattctcacaagaacaaaatattcagttcatttcagatatgatcgtgaaggtggaaatcttttttttaaaaatgagaagtgtgcccaacaaagaagtaaaagacaagttagctttctgtcatgcttgaaaactttatggaagcctgtgcattggcattagaggcatctccgacaatcagaagaacacttcttgttattataattacccatatatttttttttttttcaaattgactactaggaaaaagtgacaatttatagtaaaactggctagaaaaacctacaagaaaaacaaaaccaggttaggcatacattaatacaagattatatcaatcggaagttcgtatgcaaaattgcatatggagcaaaggaaaggacttccatttaagacgacagtatgagttataaggctaaccaaccatctcctggggagatgccgaaaaggtcaccttccatcctggtgacagatgcaagaacatccaagaatagaatgagtgcaccgttcgctggacacgctgctggtagtaggaagaatatggaaaacgcaggagttacgaagtctcaaggagttcgctcttccgctattggcccttctccgctgcagagttttactcatccaagaaggcgatcgtctggcaggtttagcgatatatccatagataatattctttctgataattcagatattccctctgccagaagagaggaaaggctatccagctcttcaagcgataggcctcgccaatatgagcggttaagttcgcgtagaaagatgatcaatcccctgcctccaagaacatcgaagacgtcacaaaagttagtgttgataccggaagacgacaacttgaaccactttcaaactctaccaacgaacgcgctggataggcaaagaccgaaagtgggctctatgaagtctaattccttcgatcggctacctcgatactcaaaagaaaagtccatggcaagaatcaccgcatataatgttgctgatggcttcaatctcaaccaattgtataagtttctgcaggaaactcatgaggtttcaccaagattgtatgatgagtgtctatacgttgcgtatactttgccacttctaccaggtaaaggcggttttagaatcaaatcaaatttatctaagaaaacaatgggtggaaagacattaattgataatttaattgatacaagcgaacagagagatcatcattatgaatattactcaggtgtggaaactgtggaagatgcaaataataattacgaactagaaaccagtggaaataacaataacgctaatcaagacaccacaacagttcccgatcatctaccaaatccagttggtcagcaagactcttttaatcctatggaaccacaattttttgcggaagaaactcccttagagatagagaaacgggaaaggacagaaagaataaacatgctgaagaaggaggaaaacgacagtgatgcaagttgtggcaacgataataataataaaaataatgataagagtaaactttatgctgttgagggaaacgatcagtatgtacagtcctctcgttcaccagcttcgccatcatcaatatctacgccatcgccaccatcttcatcacagaatgattttgatcgtgtatataaaatgcatagggacaacgaccatgaaggcaatgatagacatgcagaaattttcatttttcactatggcgttattgttttttggaactttactgaaattcaagagaaaaatattcttggtgatataacatttgcagattataagaatttaatgatccggccgctggatgaacaagatattgaaactgaacaattccatttcgaatatgacagagataccgagagaccgagaattttcaatgatattgtcacattacgttcaggtgaccacattatcgagctgacactatcacatgcgattgcgcaatcttcgaaattatcaaggtttgaatccagaatttcgccgattttaatatcagtcacaaaactacctaaaagactagcattatatggtacccttgggttaaaaagggaacagcttttgaaaaaatcagggaagctctttaaattgagagtggatgttaacctttcatccaccatattggatacacccgagtttttttggtcgttcgaaccaagtttgcatccactgtacgtggcaatgagggagtatttagaaattgaccaaagagtacaagtattaaatgatcgttgcaaagttttcttggaattctttgatatatgcgttgactctgttgctgaaagaaacatggctcgtgttacatggtggtttattcttgtcattttatttggagttatattttcattaacagagattttcgttcgttatgtaattattcatcgtcatacttctacatagatattcatacacccttctagacggcattaaaaataaataaatgatatatttagttatcaaggtttttagtcatatatttcaccgttattaccattcttggtcacgtgcaagtaaaaccactcgttgattggctcccctcaagattgcattaaaagtacaataatatgactaagggactcgaatatgtaaattcatctttcgcatcaacaaaggagaaaaagacgatagtgaagactaatattttagccagattgcagtgtttcagtgatcttaaaagtctttttcatttctagccgcattgaattctttaaagcaaaccattaaggagtacttccccaggtttttaaccgataataagagtaagataaaagtacaagaagacagggaaatgattgctacacctataagattagcaaagagtgcatatgagccgatgataaaattcgtcggtacaaggcatcccttagtgaagcatgcaactgaggtcgttgttcatccttgcgctaccaacggaatgttacctggcagcaaagagtgtattccagtgagtaaattcatggaaaattataaaccattccgtgtagtgccaataaagcatagcgctaatgctggtctcagctcgtcaaagacctctgtattcgttaacaggccattgcaaaaagatgagcttgcttccattttcgagctacctgctaggtttcggtacaaacctattaacgagcatgaattggagagcataaatagcggtggtgcatggtgaaggatagatgcagtaatattatgatttttttttgttattttatagtttctttacacatatcattatatctatgtaaaaacgtagttacttaggaagagagaagagtgatgatattatgaattgaaaaataaaaataaaatgagtatttaatgaaggtgggataaaactcttctaaattttttgagtaccgtagcctttaatatccttggcgaagtcccatttcatgttttcaacttgcaagtttttcttgaaagttaaacctgtgttcttatcaattatggccagtgagaagtttctagaagaacgggcatctctataataaagaactctcattgcatttacgatcgcctcttcagcaacctgtacagtggtctttggaatatcagattctcgatctacaactttccttaacagtgggtttgccatgtgtgccccaaaacctgtggccaaggtgggagacgaatacgtaacacctagaagatttacgtatcttaggaattgatcaccattagactgtacaccagcaacaatgatggcattccaaagtggattcatctttgatcttcgctggtacatgacggtagctagatattcaaaaatatagctgggttcgagcgcttcttcagcatccgctagaggattgtcatacgcattttcagtgactagatctttcaataatctctcaatgtgttgcatatcagaaatatcacctgaaatgcccacaacggtgttatcacccacgggaataagcctctccacgccattgaatcttagaagagagccatatgaacctaaattatctgctgcaatgataaccccattatcatatttcattgatatgacggaagtacctgttactattggttgctgtgtattaaccatgggagaggcgcctgcgttcgcaatttgtgtattgtaagcaccataagtagagtctgcgggcctgccccaactgaaaggatcgtgattcattcgtgtgggtttttatgttgttttcggcggaagatgaaggattcctgctgcttatcccctttcttaacttagctgtactttactatgtgggtacgtatttaaggtggcaaattctaaaccaagaagctggaacatctttaataaaaaggattgacgggtaaccctaaaaggaaaaataataaagaataagagtaagttaaactatatatatagaaggacgaaagaaaaggatacctcgatttttatttatttagtttgtgtatataacttaagtattttatatgtgaatgtaacgtactattggacaagatattcatctgatttcaaagaggtgatgacgtcgtaagggagctcttgatcgtggtcattggccatgacaacagattgtatggccataccggtgaaactcttagctaatttatccctcgtggactcttggaaggaaacggtcattgggtacaatgcatcttcatatggagcttcgatagtgaatgctagcgcacctgcatcgttggcagcaattttgctaatcttaatggaggttcccatttcttggtccatgttgacaacttcagcgtcagagcatgtagaagactctgtatttatgtctactggctcctgagggaaaactggaatggtgaagatcacatcagcgagttctgtttccaggacgctctcatactcaataatgacatcaaagccctgttgtgattcggagggggaaacccatgtagttagagttaatggaattaatgagtcatcttctgcgggagcgactttacgccatcttagaacacccaggctttggtcgttggctgggaaagccttagatttatcacgcagggagataagtttagtggataggaacgattgtttatctatgtttggatgggtcttaaactggaaggatttatcgcgaacgtcaatagaatcagctagttttaggttcgagtgagataagtcatggtcattaattcttagttctaaaacacctttcaattcagaagagtgaatggtaccatctctggagaattctgcattgattacctccttgatagagatcaaaataccattgttctctgggacatcctcctccggaggaggtggagtgccagaagaggctgaagaaattgcacttggccgtggtgcggcacccgctcttcttccggcaccaccacccaatttcataccgccagtagcagaatgtcccgcacgctgagacgtagccattggggaggccactggggccacctcagcagcagcggcatgggaactttgtagataagactgttgtgctgcaggagaagcatgggagtagtaactgttgatggcgtttgtaacgttaggatctttacttcccatgaacctattggcgccgtcgtaatcgccatttgaagacataaacccgtgtttcctttcatgttcttttctagcaatttccttagcacggcgcttcctctcctcagtagcttcgatctctttattacgctcaataatttcctggattctttcttcgtgcgactccatagacaagtatgtttgcacttgagtaaaggacaagttctctttgtacccgcccattgacacgatttcgtcgaacgaggacaagatctcaaaggcattgtgaaaaatctcttggtcttggaaactagacaagtaggagttgatcgtctgtgaaaacagatttaatgtggccaaatccttgataatattggactggcggtttgtgataagaataatgtagtagttatcaaagggcctatacacgtagcggacgtgcttgtcctcgacaaatgtgtggtctgacgagatctcggagactaggttctggaaattggacagcaactctaggactcgatccttggacagatctttgaattgcctggacaagagaggtttcccctgacgcgtagtgatagaagcagccaaaaccaccattgtgtatttcttttgatggagctataggtattctaatatgatctatattcgacgctgaggctaattgcccttgttcttgaggtgtcaacaaccagattttctaatttttcgctggctgttgctggaaaaatgtaaacgcgcagggcgggtaataataaaagttgaactatgaagaacaatagaaacgccaaggtttactgacagagacatgttttaattcaagtgatgaggcggaaacgtgcaagatcctaaatgaaggataaaaagagttcttaaaaagggaagtaaggaataacagagtagaaaaaccgaaaagacaacttaacaaatcggcaacacttttatggggccccgctcgcctgtgtgcaagtagtattcgacctggaacacgcatttaccacgagaagacagcaatagtccgtacaacattaattagtttcgacaattgctcgcctttataagccatgctagtgcccaatcaaacactttacttgccctgaagttccttttttcgctagcctgtaacttaaataagccatctaaccttttttttctaaaaattttctttattaccctgtcggcttattttctattctacacattatttgccacccattgaaattgtagcttgtattaatagggaaaagccggaagtataaccggtggaaagtactattgaagtgagataagaagccatcgtaatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaatatttgtatatataatatgtgcacaaaattactacaaaataaacaactttttctctcccggagaacaaagtaagtggaaaaaattatactaataacaatctaaaaatgtttattagctaggattatacacataaatatatatatatgtgtgtgtctatatttacatatactagaccgcaaaaaaaacataagggcatcactcataagaataataatattaagggagggaaaaacacatttatatttcattacatttttttcattaagcgccaatgataccaagagacttaccttcggcaattcttttttcggacaatgcagcaataacagcagcacctgcacctgaaccatcctcagctggaacaatcgtaattggatctttgcttgcgtcaccagtccatccatagatatctctcaaacccttagcggcggcttccttgaaacctgggtatttgttatagacagaaccgtcagcggcaatgtgaccagtcttgtaacctctcttttggcaaatagcggcaataccacaaacagctaatctagcagctctggtaccgatcaattcacaaagtcttctaatcaacttacgttctggcagagtggtcttgacaccaaagtccttttggaagatgtcatcagtatcttccaagttttcaaatggatcatcctcgattcttgctgggtaggaggtatccatgatgtatggttgtttcaacttgcttagatcttgatccttcaacatcaagcccttctcgtttaattcaagtaacactagacgcaacaattcacccaagtagtaaccggaggtcatcttttcaaaagcttgttgaccaggtcttggagattgttcgtcgacagcaacatcgtacttggttcttggcaagaccaaatgttcattatcgaaggaaccatattcacaattgatagccattggagagttacttggaatatcgtctgctaatttgccctccaacttttcgatatcggaaacaacatcatagaaagcaccgttgacaccagtaccgaaaatcacacccatcttagtctctgggtcagtgtagtatgaggcaattaaagtaccaacagtatcattaatcaatgctacaatttcaataggcaactctctcttggaaatttcgttttgtagcaatgggacgacatcgtggccttcgacatttggaatatcgaaacccttggtccatctttgcaaaataccttcgttaatcttgttttgggaagctgggtacgagaaggtgaaacctaatggtaaggtgtccttggtgtttagcaattcttgctcgaccataaagtccttcaaagagtcggcaataaaggaccataactcctcttggtgcttagtggttctcatgtcatgtggtagtttatacttggattgagtggtgtcaaaggtatggttaccgctcaacttgaccaacacgactcttaagttagtaccacccaaatcaatggccaaatagttaccagattctttacctgttgggaattccatgacccaaccgggaatcattggaatgttacctcccttctttgtcaaacctttattcaattcgtcgataaagtgcttaacaacctttctcaaggtctcgctgtcaactgtaaacatatcttccaactgatgaatttcatccatcaattccttgggcacatcagccatggaaccctttctagcctgtggtttctttggacctaaatgaaccatcttattttttcagtattctaattgagttgtttgggtgagtttgattaaaagaaaagaattctaattgagtattgcaagccacaattgtttcttattgctcttctgctatatattgcgctaagagaaagagaagaatacaagatgaaggaacggtagaatattcccaaggaagtgaaaccgattgcttatatacgaaatattcctctttaaagaaaaggaggaaacagaagcagttgagaacaatctttgttgcgttcacttgttactattcctctcaacggtcctaaggtaccaaaatccggggggagaaagaaactttttcttttcatcaaccccttaaaaaaaaatgcatagttcttaggtcttccattttttcttttgttggtttttgcaaccagagtatttttcctggttgctccagtaaggtatttcgctatcttccaacaaacggggcacacgtgcgggagtttcaaaggggcagaatagtggggttcaggggcataagaagctcacacaatgcggaaaaacaaaaggggactgccattcttcctgaaacccacgcgtcactgctatactgagatctggccaggggcaaccagtatacttagtggataaacgacaggaacacgtactccttaaaagcgtctaaatcttcatttttccggtttatttccaaccgggaaataaattattcctaataaaatttccggggtttgcaggatgcggggtaaaagtaaaaaaatgaaaaagatgtaaaaagaaaagttcgaggtaagaccaggtgcaaggagaatactgggcgccaatgcttttactgcagcgaagaaaaattctaaccgtctgtttcggttgctaatttttgtcttactttcgatggttaggcttcgtggggtaaaagtcgagcttgttttctgaagcggaaattacagcagtttgctaggtgagttttaactttcctagttgcatcccatggtctagataatcaccccaccccacgccattctttttttgcaacacgggctttgttcctgaaacaactggcatggaagatattccggggttgtttaacaataaacgtgtagagtacaggtagaatataggcgaagccgcggtgagcacggaatcgcgcatggaagaaaacacaccaggtaagcctttggaacgccatgtgtaaggtgcaatgcacatgagtgattgttaaaaacagaaaagtaaaaattccgatcttgtctggaggatcaatcgtcctctcagtgcgttttcttggcgagacaattcaattcgctttatgctctttttttttgtgaatttagccaattccggaaaaaacataaaaaaatggttatgcattctttattttgaagaatgaactagatatacagtaatatactaaattgtcagctctcggcataattcaatggccggaaagtagtactattaaaaagaagtgcgctcaaagaataactccgggaataggtgatgtagcttttggtgctggaagcgaaccgctttcatgtgttttggtcccggctgtagtgttctgcggagttgcactggtgctgttggtagagattacgattttggtaaatcctggtgtgacggctacatcagtacctctagttagaccaaacactaattcaatgccaaaacttagacgcccgatgatattccttgtatatatattattatccgctatgggcacagaagtatgtttaacagtagcagaagcgacttatgtatggatgtccaacaacgaagatgccacaaacgtcttcgtagttttatccacggcgccaggtctggagaatggacaccagggtactaaaatcattaattgctcttccaccatcctaacgttgttgacatttagtgtagatacttggtgaaatatgtgcttgtgaaagcgattgtccattctttatatatagtcatgaaagtagttaaagtgaagaatatattagaagctttgggttcaaaagaggacggtgaagtggctcgctttgttaatatattgatttatccgaaacccgggaagcactctagaactatgccttagcattttagtggtcgaactagccagtttttcgattgttggatgtgttgtaatgacggtattatttttgctcaatgagttaaaaggcgaaagcgtcaaattgtaggtcagaatatgactgacagaatcaaactgtctgacaattgcacaggaggattggccggagtaaaatcgtttaaggtagtataagcaggttgagcagacaattggctagagctagccattgagcctaaagaattgcgaacaagtcggataagacaaagggaactaatgtacaagatcttgtatcctgagaagaggaaataagtactcaagaatgggccagaaataatgttagagtttataggggtgacagcccttgagctaataaatactacaataacagtgtccgtttgaatgctggtcggtgaatcaatcaaagatttggttgcaatgatatgtgcaattttgctgatggagcttgctaaagttgtgatattagtcgagatccaattagaacggattaggcgggaatcgcttgagggatcgccaaaaatacttgtgatttgtgtaagttggttgtaatgcaaacctgctatctttactttcgaacaaaatagatgaatcagcggctaagtattctgtggctaatgtgctagatacatgttgagtactgctatttgtgcgcaaccgttctaacaatgctgagagatgatgaattgaatatatcagaagttttactagctacagtagttgaggtaccaatagtgggggtatgcgaaaatttactaaaagcactgactggagttgtggtactagtgaatacctggtccaaataggttatgaaggaatcatttgagaattggctagaagcaactaaaacgcccgtggattgaggttcagatttgctactgtcgctttcgaagaagctagatgaaccacgggtaaagtattctgcatctaatgtgttcaataaatattgagtgacgttatcgtaatgttacagtactaacaccgctagaaaatgctggtgtgaatgtgaatgacgatagacggactgatgcacttttccattgtacgataacattacttacaagattgggagaagcatgattgaaaatttgactggaagaaccacttatattaggagtggcggtattagtagaaaattgactaaacgcatccgaaaattaaatagaatttaaagtttccttgggtgcactgttttgggctgcagtgctaaaatccagaagtgttggagtcaggttacttgtttgcatacagacattactgaagttttcagaaggcctttgaatcgagaacgagataaggaagtgtcctctaaatgcaattttagagctcaaagtgaggatagtggcactgaaacttgatttagttaatggcctttagatttgctgctgtctgaaaagctcatcatcgagaagctcacaaaatggagttctagttgccctttcactatacaatcgatgtaaagatggcttataagtatttgaattgtaagttttgtgctagctgaggaatcaaaaaatgtatttagtgcttccttactggtcaattgtgtattatttccagatgaaacagaaaatatgtattttatggattgactaatcaagtcacttgctgattgtgtaatagtggtggttaaagaaagtacagtaagtttgcttgaaatacaggcaggattcctggaatactgcctactactgcttattgaatagagtgtaatctcgccaaacccagtaatagcatcgtttaagaaatggtgcttacttgtaggtaaaacttctgaaggatactgagtaaatgtaaaattatatgagttaaggcagaatgactgtaaacttttgtgacgaatctggaagatgcattcgtcgattggccttcattaagtgaagattggtaacctattgcatccaaaccagaagtaatacaaccagaatgtggagatgaggagccaacaggtgtgtatccagaaggttcagccacaggttggtcatcaataccactgggggagcatgcaatataatcagatggttgcgaggaatagctagtagagctaaaactgaacacattagttaagattagactagccatgctcaaagaaacaattagagaggcacctacatgttcgttatccatttttgaggaaaaaatagaagtgataataataattttgctcgaactactcgtaaagctacttgaaaaacggctcgagattacggaagagtcggtagtaaaccgactctcagtgtcacggaatggaagcgccttgaaactactaatatcaggtatgcattgaggggcaaggcaacctgaatatgcaaagagcatagtcttaactttcgtagtacgtaatacttcggcattaatttggcctaccgctttgccacagttgagtggtcactggagtattagccatgaaaaaatgatcccttgtatatccaggcccaaagtctaaaatgtacttcctgccaatggttgtcacagctaatattccattttgaattgacttgatttttagattattatcatggaaccaagttgatgtcttgcaatttctgatttttaacgatgtactggaggttgacgactaggcaaatctgcgaaacatcctagtacaatggcatttggttctgatgacaaaacaatagtttgttcctccactgaaatgttattcaaatcttcgatataaaaaatgcggtaatttcagacccaaagacatccattacccatcatgctaaattgtgggataagatatatatggttaattgatctgattcagctgcaataatatcggtatttattatggtaccttccatgctctttgccgaactgcagataacctgcgtctgcaaattgcaggaattactgaaaatgaaattgctaaactttgggagctactagaagaaaaatgagtacctctcctacttatatttcccattttcttgaaggtttctccttcccatataagaattccaaacggtgttcctttacaaacccataagggtattaaaatgattctcaaaatttcctactgcactattgttttttctttctaatagatgaatcatccgtacacacacagagaccaccgtttactttcatatcagaatagaagttgtgaaagctacctacgagacttaaataaacatctttttcgatggtgagcttttcatggtaattcgtcgagacagtaactgttttgctcttttctatgatgtctaaagccaaaacaatgtccatcaagactagcgtaataaaaatcaacctgctcattgacaattggattatttttggctgttcaagattaaaacagactcagtaggcaaaaacttcaatcaatagtaccgggaagatgacattccggtctaagtggtattatacacttatagtaaagtcacgtcaacctttgttacttttcttaattgattatatacgcactcttctcaatatttgatttcttcatcgaaaagatctacacgaagtttttatcatgtgttagcgtgatggaaaagatctgtgcacgtttaattagaattgcaaaagcttcaatgggtttgattgagatttttattttcaattcactcatcttgatgttcaccaccaagcctacatcgaaactttgaaatacaggaaagttgcaggaggctttattggttgaattgaaaaagaaaggaagaaaaacgtaatggtaaaataaaactcgactatggcgcaaccgatagagagtttagtggcattagaaattttaaaagaagctttaaactacaaagtgttcttctgaatctgaataaggtcacttacatagaaacctacttacctcaaaagcgtaattccgaaaggcaaaagaaaaacttttgtagaatcttcagctgctagaagttcaaatagaagacaaattacggacttgttgcagtatatgccaagctacagaagaaattatatttcttaatacgtacagaaggtatgaaacgttagtttactcacagaagataccctggcttttcttttattaatacatggagttgcaaaaaacaagggaaaggaaaatcaatcaaattagaattaaggttttttttggacagtgcagcgtcaatgcgcacgtaatggcttcgaagaaaaaaagaaggcaaatacaatgaagctgagatcttgttttatcatgaggggaaataaattggaagcattgaagttgttggaatgaaactctaaaatatcatctgtttagtagtatcgtgttactagtacattatcacatacagtgtaagaaaatgacattaggtatgagaaacagtcatcaaatctaatggaagcgaaattcaagggttggtgatgtaataggataatgaaacatataaaacggaagtaaaaataatcgtaatattacaaggagaccaaacaaacagtcgagagaagcgtatgcacaatcatgcaagaaaaattttctggaagaatttatttaatcttaaattacaaatcttagtagtaatggtcacttctgatagtttcgaaaaaggaaagaggagatgactattgagtcaaatttttttgacggaaacttagcgaccgaaaaatatatatgataataagaaaacgaatggcatacaatgattagtttcaaatatttcacgcgcaaagaaagaattctactaccggagtgtgcccttcttgtactttattatcagactgtgtctctctaattgcgtgttgtccgcggaataatgctctaatttaaaaaatcgacatattctgacttgtatggcgctttgcattggtgtttatatgttaataacccctaatcatactctatatgaatactttcaaatttaccaacacaataaaatcttcatattctcatgcatgttttgccctgtatcactaaataatacatactttaccgaagctggttgtatttcgtgtatatcatagccaatgatgccgttataatgtccgaaatattatcgcttaatgaagggaagcagctaacaaatatgacaaatacagcaatttcttacaccggtaactaatgattatacaaacaagacttgattttttttatggcctgtaagaatatatcataacgtgagttctagatatttaaagttctttatgcatattctagtctacgtatataggagttccaaaaaaaaaaaaaattaaatgcacgttattcttgacgctagtgtaagtttttatgtactttacctgctagcttcgtatttctgtcttgggatattcttgtccctattatgagaatgtacaatatgcaaaataaaggtaaaagatttgaaaaagagaaaatacccaaatatcaacaaaactacctctataggacctgtctcatggtcttgacaactttatgcgaaataagaacacgatcgttatatcacttaacgcttgagatatatacagaatgtagtacatgtcggcccttctacggatttattaccatgtgtatactagaattgataccggcaacccatagtgacttttaacagggcaattggatttgcataaaagtatatacagtaataataatatttcctgatgagaaaggtggaaagtatcgagttatgtgtaccttcaataccaatctctacctctcgttaatagtgccacaatgctatggattctaagcaatttaaaccgcatagctattagtgtagacttcccactgtatttgaatgacacgttgccttcattccttgttgcgctgaactttcacgtcagatatatatacataagtgcaatagaggcctaggctaatctgcaaatttctcatagatgtacaccgcctgtgccgtacggcatcgctatcttctgaaaggaaactgtagtaaatttaccaaaatatctccgaataaaaagaagaggaacatcttttaatgaattatagagtacaaaagaatcatttaaaagagagggcgagtgaaaacatgaaaagaaacgttactaacttaattgaccttaaagtagcctcaccagttaagtgcattattgatcattccatgaataaccatttttaaagactaagatgctgagttgtgttatatagagagaaaaaaacgtactttcagtttccatatgaggtggagcgcaggtcataggtatgccggctcattgttttctattttaaaaagtaaaaaatatgctgctaaaggaacacgtgagaaattacattctccctaggtctgcgataacgcggtaatattacactgccgccgccttccatgcctttggaaagcagacaatgatgctaggcggcgcccagcagtataaacttttcttgcttataaccagaacctctatcacaaaattagaaactgcgatactatgggtcagatcgacacatagggagcactattaggcgcaaggcgtatacataggcattgcgtgttcaaaaattgtcgtatgagaaaagttccaaactttccaccattactcaccaacaacttacaccagcccggatttaagatttagcttccgagaatattgtgactcagccactggtctcttgaatgttgcgtgtagcttgattaagattatggcataaccgttttttttacttggcaagagtgaacgtccttttactccaaaaggctcctgatgaaactggagagtctctttgttctgaaatttttaaagtttagcacaccatattcacgctcgaggtgaacccaagttttcctgaaaaatgtgccatgaacctgaaaaaaagaattattctcgaaaataaaaaaggcaatcaagatcggaaagataagcattttttttcaatccgtatctaacattcataaagtgataaaaaaattgataacgattttattgtcgcctcttgttttgagtatatttttttaacgttctttttcggcattcaaattccgtataatcaactcaattgtaaggcgccgtagcatccaaataatgttgaaagtgccaatttgctcatcagtgctaaatattccttgataaaaatatagaagacaaggacatataaaaagaaagactgctctagtgttgggacaccacaatgaaaaaatacttaacgtgtttcgaaactgtgaatataaaattccagcaaaaaccaaaatattcactacaatgattgatcgtaccgagttatcgaagtttggtattactacgcaactgtctgttattggacgtaatccagatgaacaaagtggctttgttaatccacctttgtataaggggtcaaccatcattcttaaaaaacttagtgatttagaacaaaggaaaggaagattttacgggacagcaggttctccaactattgacaatttagaaaatgcctggacgcatttaaccggcggtgctgggacagtgctatcagcttctgggcttggttctatctctttggcgctattggccctttcgaaagctggtgatcatatcttgatgactgatagtgtctacgtgccaacacgtatgctatgtgatggtttattggccaagttcggtgttgaaacggattattatgacccatcaatagggaaggatatagaaaaactagttaagccaaatacaaccgtcattttcctcgaaagcccgggttctgggaccatggaagtacaggatattccagctttggtctctgttgccaaaaagcatgggataaagacaattctagacaacacatgggcaacgccactcttttttgatgctcatgcgcatggtatcgatatttcggtagaagctgggacaaaatatttgggtggtcattcagatcttcttattggtctggcctccgcaaatgaagaatgttggccgctattacggtcaacttatgatgcaatggcaatgttaccaggtgccgaggactgtcaattagcattgcgaggaatgcgtacattgcacttaagattgaaagaggtagaaagaaaagccctggatttggctgcttggctcggaaatcgagatgaggttgaaaaagtgcttcaccccgcctttgaagattgtcccggacatgaatactgggttcgtgactacaaaggttcttcaggcttattttccattgtccttaaaaatgggttcacaagagctggtctggagaaaatggtagaagggatgaaagttttgcaattgggattttcatggggtggctagaaaagcttcaacatggccttacaaaggttttgcactaagaatacaagtgggtctcgaagaatttgaagatttaaaaagggattttgagttaggctttgaacgtctcgcagaagaaatttctttgaatcctttacaaatctgattttttttccttttttttttggatttccaagcaatgttgtttgagaaatgaatgaaatttttgactatagcttgtcttaggcaggctggagtagacaaccatctagtagccaatgtttgcccagttaatatatggttcaattttctagctgtatcatattatggatgatgaagcagataatctttcttttttctgtatgtctgattgtaataaagaggcttaccatattgtgaatgcatttcaatgacactgcataatgaagtcattgtatttagaaaagtaataattttgtattgtataaagatagaaaaaacgtatatcgtacttattcagcggaaatgattctgctttatctacttgcgttcctgaatataatatttgtgaaccaggcttgagcttgacactacagattttttagttcgatttcattcagtagagaaaggcatatcaatatgacatgtgatctcactccgcggctaaatgctagcaataaaaagaataccgtaatagagatgcagcaaaataaccactggtgtttaagaaataatatgattacgtcagtaaccgaagagcccgtacgcactctgctaccatagactatgtatattgttacctattgtaaatagctatggttactctaagtacgtatggtgctatgcatctcggtgaacggatgcaattatgaaagtgtaggtcagaacatcatcggtggttttgtcgtgtaaaaaaggttataaggaaaattatactcacatgattttattcatcatcgtctgtgtatcgcttcaattaacattttgaaaaagagattactttatatgacgttatgtatatctttcaacttaaataaccttagctggcaaaataaagaataagataagggccaagaagaacgctaatactcgttttttttcaactacaaaacaactagttggataattttgaaacaacaaagtagaagttgtacatatatttttgcgcatatggctctgaaatatcgtatttttcaaaagcccgatacaaagccgtcagcaatacccatagttaaagattccttgataacctatagcttccgtagacaacaacacaaatttaccacctacttttaactcacccatgtttttcagtttatcaatgaatctaataaacgtggcttacgtaacagctccgcatggacttgaatttactcctagcgagcctagtgttttaattgcttgcatacaatcttcatcggaaactaaacaggaaatagatggcccctttctgtagtagaagaaatgctgttgctgaaatcctcggacagttcaactcatccatgattgttctagaggttcctagatcagatgaagccttttgtaacaccaatgacttattgacagtgtaagcggtatctggttcaaccgagaagactttcgtattcgatttatgcgacctgtaatatgttatcactccttgagcaaaagaatcagccccacaagggacaaatattaccgcaggatcgaatggtatttcgctacacaaggtagtgtaaccataagaaatccagttaggaatttcatcataacctatgaatgaaaaatcttgaataagttgatttttttgtcggatcgctactacaaaactctaaagaactttttattgcataatcatagttacctttaattttgataacttctgctcccttttctgatctgatgttctcacgctctgttctagaacattccatggagtaaatattgtagactttaagcctaggatttttgccatgtatgcaactgctctaccatcattaccatctgtaacagccgctagcatcaaagacgggtgttggaatttgacaatttgcttcaatgtatccaaggaagttttaggtaatggcaggctaaatcttccaatcaaacagcaaaatacacctcaagacgccccaagaattttgaatgaaggcgagctgaatcccgaactttgttctttaatgtacaatttaataccaaaatgattatccaacttgattagcttcgatgactcatacagatccataccaatatcaacttcacggataactttttcaactcttttaaattcttcaacatcatttttcgatcaaactgcgtcaggttttacatatagatcaagcgttgtcggtttatactacgatgtcatttacgatctgctgccaacagaagaaacattacgcagtaccttggaaaaatctaggcaatttatagacatgaatctcctatcgttcttaaaacaatgtatttcctgtcgttgtctcgattctcttttttgctattctgaaggacaggtccatttatcatccagaattctaatcccgaatttaagatatcgtaacagtaacaacatcatatccaagcaccgaagattcattgctctatattccttgtcttcgaataaggaagataccgcgaagagactctttaggagtcgggcttgactccctgccaaagcagctattcctgtataacacgcgatattttatctccttgtcgtcatgtgaaagtcaaacagcgcacgtttgtttgatgaagcagcaactctcctcttactgcttttgcagaattttgtgagaagctctcttctcttggaactaacctagccatatggctttctgccctctttccgtcaacattacaagataaagatatcggtataatttaaagattcgacctttacgccctacatggctaaaattacaatgccaaaattatcatgaattcactttgttgacccggaattacaatacaatgcttctaaaaagagatttcttttaaatttgtcaagggaagtcatttatctccacacaaacgcacaccgaaatatatatatatatttaaatttcctcattctttgttgacaggttgatttgtaactagaaatcaaataatcgggatgcgcaataccctgtagtagtcgattcaaaaactgattaaaaaatcactgacatttagcataagcgactgaaaaaatgtactgatttcttctcgagtcatatatactattacatgagttcgagtatggtgttgttttctttagaatgtcttatcaagaccgacaattcatacaggtcgagatatgtaaagtctacatgccgagctaggatgagaaaaaaagtatacaaattgcaggcaaataaacacaccaaaagatactaaaaaaatcttttaaagttttggttagttattggggatcatcatgcatttaacgacaacagagaaaagaaaaacaaaaaaaaacaatacaatgtaaaaagcagtactatgtaggaataaatcctgcctcaattgcagaaaaaaaaaggtatgcgtaatctaaataagatactatgtattgatatttcatatcactaacttctctcagatcaaatatgatttaaaggagcgatttctggactgtacaaaaaaaagaaatagactacttacatcctatgaaggtcagagaataaaacgcttttccgttaaaaagatccaccatatggaagaaaaatacgagagttaaaatgctatttaaaagtgctaaaggaatccccagagacctcagctgagataagtaatatcgttgatgaattacaagggaacaatgagcagagggaaaatggacagatcctttcgcattcctacttgtttgatgagttcaaatgtgaaatagtagcaacaaaaggtcataaatcttcaatgatatttggacctactagtgtctatagtaagtgctcggccaagtcaagcggtatcattaaagacaccgccaagcttccaatatcacgagtaaggatcaaagttatgttagagataactgtgagttttttattttttgatcgatttccaagatcattcctcaatcataatctatatgattcaatatgtcctttctttgcgtggcaatatacctcatattatctttctatttacaggcagtcctttctatttcatttcttacaaaaggattttagcaacgacttcgtctcagaagagttaatatatgcactagttgcactaggcgcaaaaaattcctttgacaatagcctttcaaagcatacatatgaatattacaaccactcaaagagaaatttactggaagattcgacaaataaaaattcagctttttcaagtgcaagcgtaacaaagccataatgcctcctatatttagccttttttgatataactgtcggagagttaacaagcggctggactactttctggaatagcgttcggaatgtgttttacttaaggattcgaacgtgatcctaacgagtggatgcacagttcagagttatctaacaatattcgtgaaggatatgtcaaaattggatacgcttatgtttatgatatatcatttatattaatatatagtatgctcacattttcttattgctgaatagttcttttttacgtttagctgagtttaacggtgattattaggtggattttatattagtctacataaaaataagtggtggatatctacataaaattgtcataacgcgtaaactaaaaattatttttatgatcattgaggatctataatcaactatagacattaatgtatggataatcatgaggattataggtaaatggcaagggtaaaaaccagtgaggccatttccgtgtgtagtgatccgaactcagttactattgatggaaatgaggactggtcatggggcgcaatggagtgaagtaatatatactttagcatacgtgtgcgtacgccatatcaatatgctagtgaggtggtgtgggtgtggtgtgtgggtgtggtgtgtgggtgtggtgtgtgg
